US009157097B2

(12) United States Patent
Cooper et al.

(10) Patent No.: US 9,157,097 B2
(45) Date of Patent: *Oct. 13, 2015

(54) VECTORS FOR PRODUCTION OF GROWTH HORMONE

(75) Inventors: Richard K. Cooper, Baton Rouge, LA (US); William C. Fioretti, Addison, TX (US)

(73) Assignee: PROTEOVEC HOLDING, L.L.C., Baton Rouge, LA (US)

( * ) Notice: Subject to any disclaimer, the term of this patent is extended or adjusted under 35 U.S.C. 154(b) by 0 days.

This patent is subject to a terminal disclaimer.

(21) Appl. No.: 12/567,513

(22) Filed: Sep. 25, 2009

(65) Prior Publication Data

US 2010/0093036 A1     Apr. 15, 2010

Related U.S. Application Data

(60) Provisional application No. 61/100,157, filed on Sep. 25, 2008, provisional application No. 61/231,575, filed on Aug. 5, 2009.

(51) Int. Cl.
*C12N 15/63*    (2006.01)
*C12N 15/85*    (2006.01)
*C07K 14/61*    (2006.01)

(52) U.S. Cl.
CPC ............ *C12N 15/8509* (2013.01); *C07K 14/61* (2013.01); *A01K 2267/01* (2013.01); *C12N 2800/107* (2013.01); *C12N 2800/90* (2013.01)

(58) Field of Classification Search
None
See application file for complete search history.

(56) References Cited

U.S. PATENT DOCUMENTS

| | | |
|---|---|---|
| 4,670,388 A | 6/1987 | Rubin et al. |
| 4,870,009 A | 9/1989 | Evans et al. |
| 4,914,025 A | 4/1990 | Manoil et al. |
| 5,102,797 A | 4/1992 | Tucker et al. |
| 5,162,215 A | 11/1992 | Bosselman et al. |
| 5,212,080 A | 5/1993 | Nag et al. |
| 5,512,483 A | 4/1996 | Mader et al. |
| 5,556,782 A | 9/1996 | Cooper et al. |
| 5,565,362 A | 10/1996 | Rosen |
| 5,645,991 A | 7/1997 | Berg et al. |
| 5,648,244 A | 7/1997 | Kuliopulos et al. |
| 5,693,508 A | 12/1997 | Chang |
| 5,703,055 A | 12/1997 | Felgner et al. |
| 5,719,055 A | 2/1998 | Cooper |
| 5,733,779 A | 3/1998 | Reff |
| 5,753,502 A | 5/1998 | Kilgannon et al. |
| 5,861,478 A | 1/1999 | Jaynes |
| 5,869,296 A | 2/1999 | Nag et al. |
| 5,925,545 A | 7/1999 | Reznikoff et al. |
| 5,948,622 A | 9/1999 | Reznikoff et al. |
| 5,958,775 A | 9/1999 | Wickstrom et al. |
| 5,962,410 A | 10/1999 | Jaynes et al. |
| 5,965,443 A | 10/1999 | Reznikoff et al. |
| 5,998,698 A | 12/1999 | Cooper et al. |
| 6,080,912 A | 6/2000 | Bremel et al. |
| 6,107,477 A | 8/2000 | Whitney et al. |
| 6,140,129 A | 10/2000 | Cox et al. |
| 6,156,568 A | 12/2000 | Cooper et al. |
| 6,159,730 A | 12/2000 | Reff |
| 6,159,736 A | 12/2000 | Reznikoff et al. |
| 6,171,861 B1 | 1/2001 | Hartley et al. |
| 6,218,185 B1 | 4/2001 | Shirk et al. |
| 6,255,282 B1 | 7/2001 | Jaynes |
| 6,258,571 B1 | 7/2001 | Chumakov et al. |
| 6,261,554 B1 | 7/2001 | Valerio et al. |
| 6,291,214 B1 | 9/2001 | Richards et al. |
| 6,291,243 B1 | 9/2001 | Fogarty et al. |
| 6,291,740 B1 | 9/2001 | Bremel et al. |
| 6,303,568 B1 | 10/2001 | Jayes et al. |
| 6,316,692 B1 | 11/2001 | Readhead et al. |
| 6,358,710 B1 | 3/2002 | Graves et al. |
| 6,376,218 B1 | 4/2002 | Hsu et al. |
| 6,376,743 B1 | 4/2002 | Yanagimachi |
| 6,475,798 B2 | 11/2002 | Fogarty et al. |
| 6,489,458 B2 | 12/2002 | Hackett et al. |
| 6,492,510 B2 | 12/2002 | Hasebe et al. |
| 6,503,729 B1 | 1/2003 | Bult et al. |
| 6,514,728 B1 | 2/2003 | Kai et al. |

(Continued)

FOREIGN PATENT DOCUMENTS

| | | |
|---|---|---|
| AU | 2003261096 | 1/2004 |
| EP | 1375654 | 1/2004 |

(Continued)

OTHER PUBLICATIONS

Sarkar et al (BMC Biotechnology, 2006. vol. 6. No. 27, pp. 1-9).*
Kim et al (BioProcess International, 2006. vol. 4 No. 3, Supplement, pp. 24, 26-31).*
JP 2004-518011 Final Decision of Rejection dated Mar. 2, 2010.
Geyer et al., "Protecting against promiscuity: The regulatory role of insulators," CMLS Cellular and Molecular Life Sciences, Dec. 2002, pp. 2112-2127.
Largaespada, "Generating and manipulating transgenic animals using transposable elements," Reproductive Biology and Endocrinology, vol. 1, No. 1, Nov. 7, 2003, p. 80-89.
Maksimenko, "Insulators of Higher Eukaryotes: Properties, Mechanisms of Action, and Role in Transcriptional Regulation," Russian Journal of Genetics, 42(8), Aug. 2006, pp. 845-857.

(Continued)

*Primary Examiner* — Celine Qian
(74) *Attorney, Agent, or Firm* — Kilpatrick Townsend & Stockton LLP

(57) ABSTRACT

The present invention provides novel compositions to transfect cells for production of growth hormone (GH). These novel compositions also are used to produce germline transgenic birds that can successfully pass the transgene encoding growth hormone to their offspring. These novel compositions include components of vectors such as a vector backbone, a novel promoter, and a gene of interest that encodes for GH, and the vectors comprising these components. In one embodiment these vectors are transposon-based vectors. The present invention also provides methods of making these compositions and methods of using these compositions for the production of GH in vitro and in vivo. In one embodiment the GH is human (h)GH.

8 Claims, 6 Drawing Sheets

(56) References Cited

U.S. PATENT DOCUMENTS

| | | |
|---|---|---|
| 6,515,199 B1 | 2/2003 | Petitte et al. |
| 6,528,699 B1 | 3/2003 | Meade et al. |
| 6,563,017 B2 | 5/2003 | Muramatsu et al. |
| 6,602,686 B1 | 8/2003 | Harrington et al. |
| 6,670,185 B1 | 12/2003 | Harrington et al. |
| 6,716,823 B1 | 4/2004 | Tang et al. |
| 6,730,822 B1 | 5/2004 | Ivarie et al. |
| 6,759,573 B2 | 7/2004 | Olhoft et al. |
| 6,825,396 B2 | 11/2004 | MacArthur |
| 6,852,510 B2 | 2/2005 | Bremel et al. |
| 6,939,959 B2 | 9/2005 | Hu |
| 6,988,815 B1 | 1/2006 | Rizkin et al. |
| 7,005,296 B1 | 2/2006 | Handler |
| 7,019,193 B2 | 3/2006 | Ditullio et al. |
| 7,034,115 B1 | 4/2006 | Kawakami |
| 7,083,980 B2 | 8/2006 | Reznikoff et al. |
| 7,105,343 B1 | 9/2006 | Frasier, Jr. et al. |
| 7,129,390 B2 | 10/2006 | Ivarie et al. |
| 7,160,682 B2 | 1/2007 | Hackett et al. |
| 7,199,279 B2 | 4/2007 | Rapp |
| 7,294,507 B2 | 11/2007 | Harvey et al. |
| 7,335,761 B2 | 2/2008 | Harvey et al. |
| 7,375,258 B2 | 5/2008 | Harvey et al. |
| 7,381,712 B2 | 6/2008 | Christmann et al. |
| 7,527,966 B2 | 5/2009 | Cooper et al. |
| 7,597,884 B2 | 10/2009 | Blatt et al. |
| 7,608,451 B2 | 10/2009 | Cooper |
| 8,071,364 B2 | 12/2011 | Cooper et al. |
| 8,236,294 B2 | 8/2012 | Cooper et al. |
| 8,283,518 B2 | 10/2012 | Cooper et al. |
| 2001/0044937 A1 | 11/2001 | Schatten et al. |
| 2002/0007051 A1 | 1/2002 | Cheo et al. |
| 2002/0013955 A1 | 1/2002 | Ogden et al. |
| 2002/0016975 A1 | 2/2002 | Hackett et al. |
| 2002/0028488 A1 | 3/2002 | Singh et al. |
| 2002/0028513 A1 | 3/2002 | Fogarty et al. |
| 2002/0042137 A1 | 4/2002 | Richards et al. |
| 2002/0052047 A1 | 5/2002 | Hasebe et al. |
| 2002/0053092 A1 | 5/2002 | Readhead et al. |
| 2002/0055172 A1 | 5/2002 | Harrington |
| 2002/0056148 A1 | 5/2002 | Readhead et al. |
| 2002/0072097 A1 | 6/2002 | deCardayre et al. |
| 2002/0076797 A1 | 6/2002 | Lin |
| 2002/0083479 A1 | 6/2002 | Winston et al. |
| 2002/0099015 A1 | 7/2002 | Barber |
| 2002/0104109 A1 | 8/2002 | Bremel et al. |
| 2002/0108132 A1 | 8/2002 | Rapp |
| 2002/0119573 A1 | 8/2002 | Shaw et al. |
| 2002/0129398 A1 | 9/2002 | Winston et al. |
| 2002/0132349 A1 | 9/2002 | Goryshin et al. |
| 2002/0133835 A1 | 9/2002 | Winston et al. |
| 2002/0138865 A1 | 9/2002 | Readhead et al. |
| 2002/0148000 A1 | 10/2002 | Shen |
| 2002/0150577 A1 | 10/2002 | Lee et al. |
| 2002/0151034 A1 | 10/2002 | Zhang et al. |
| 2002/0157125 A1 | 10/2002 | Lee et al. |
| 2002/0160507 A1 | 10/2002 | Novy et al. |
| 2002/0188105 A1 | 12/2002 | Craig et al. |
| 2002/0199214 A1 | 12/2002 | Rapp |
| 2003/0009026 A1 | 1/2003 | Hasebe et al. |
| 2003/0017534 A1 | 1/2003 | Buelow et al. |
| 2003/0055017 A1 | 3/2003 | Schwarz et al. |
| 2003/0056241 A1 | 3/2003 | Matsuda et al. |
| 2003/0061629 A1 | 3/2003 | Sutrave |
| 2003/0074680 A1 | 4/2003 | Lee et al. |
| 2003/0074681 A1 | 4/2003 | Macarthur |
| 2003/0101472 A1 | 5/2003 | Baltimore et al. |
| 2003/0115622 A1 | 6/2003 | Ponce de Leon et al. |
| 2003/0121062 A1 | 6/2003 | Radcliffe et al. |
| 2003/0126628 A1 | 7/2003 | Harvey et al. |
| 2003/0126629 A1 | 7/2003 | Rapp et al. |
| 2003/0138403 A1 | 7/2003 | Drustrup |
| 2003/0140363 A1 | 7/2003 | Rapp |
| 2003/0143740 A1 | 7/2003 | Wooddell et al. |
| 2003/0150006 A1 | 8/2003 | Petitte et al. |
| 2003/0150007 A1 | 8/2003 | Savakis et al. |
| 2003/0154502 A1 | 8/2003 | Wimmer et al. |
| 2003/0167492 A1 | 9/2003 | Lee et al. |
| 2003/0170888 A1 | 9/2003 | Van de Lavoir et al. |
| 2003/0172387 A1 | 9/2003 | Zhu et al. |
| 2003/0177516 A1 | 9/2003 | Horseman et al. |
| 2003/0182672 A1 | 9/2003 | Graham et al. |
| 2003/0182675 A1 | 9/2003 | Etches et al. |
| 2003/0217375 A1 | 11/2003 | Zcharia et al. |
| 2003/0221206 A1 | 11/2003 | Schatten et al. |
| 2003/0224519 A1 | 12/2003 | Harrington et al. |
| 2003/0227774 A1 | 12/2003 | Martin et al. |
| 2004/0006776 A1 | 1/2004 | Meade et al. |
| 2004/0018624 A1 | 1/2004 | Harrington et al. |
| 2004/0019922 A1 | 1/2004 | Ivarie et al. |
| 2004/0037088 A1 | 2/2004 | English et al. |
| 2004/0040052 A1 | 2/2004 | Radcliffe et al. |
| 2004/0110143 A1 | 6/2004 | Bennett |
| 2004/0142475 A1 | 7/2004 | Barman et al. |
| 2004/0158882 A1 | 8/2004 | Ivarie et al. |
| 2004/0172667 A1 | 9/2004 | Cooper et al. |
| 2004/0197910 A1 | 10/2004 | Cooper et al. |
| 2004/0203158 A1 | 10/2004 | Hackett et al. |
| 2004/0210954 A1 | 10/2004 | Harvey et al. |
| 2004/0226057 A1 | 11/2004 | Christmann et al. |
| 2004/0235011 A1 | 11/2004 | Cooper et al. |
| 2004/0255345 A1 | 12/2004 | Rapp et al. |
| 2005/0003414 A1 | 1/2005 | Harvey et al. |
| 2005/0004030 A1 | 1/2005 | Fischetti et al. |
| 2005/0034186 A1 | 2/2005 | Harvey et al. |
| 2005/0050581 A1 | 3/2005 | Harvey et al. |
| 2005/0066383 A1 | 3/2005 | Harvey |
| 2005/0176047 A1 | 8/2005 | Harvey et al. |
| 2005/0198700 A1 | 9/2005 | Christmann et al. |
| 2005/0208038 A1 | 9/2005 | Fischetti et al. |
| 2005/0273872 A1 | 12/2005 | Sang et al. |
| 2005/0273873 A1 | 12/2005 | Christmann et al. |
| 2006/0046248 A1 | 3/2006 | Rapp et al. |
| 2006/0121509 A1 | 6/2006 | Hermiston et al. |
| 2006/0123488 A1 | 6/2006 | Ivarie et al. |
| 2006/0123504 A1 | 6/2006 | Leavitt et al. |
| 2006/0171921 A1 | 8/2006 | Ivarie et al. |
| 2006/0185024 A1 | 8/2006 | Ivarie et al. |
| 2006/0185029 A1 | 8/2006 | Ivarie et al. |
| 2006/0188478 A1 | 8/2006 | Ivarie et al. |
| 2006/0210977 A1 | 9/2006 | Kaminski |
| 2006/0218652 A1 | 9/2006 | Horn et al. |
| 2006/0236413 A1 | 10/2006 | Ivics et al. |
| 2006/0258603 A1 | 11/2006 | Ivics et al. |
| 2007/0009991 A1 | 1/2007 | Horseman et al. |
| 2007/0022485 A1 | 1/2007 | Tadeda et al. |
| 2007/0113299 A1 | 5/2007 | Harvey et al. |
| 2007/0243165 A1 | 10/2007 | Ivarie |
| 2007/0263393 A1 | 11/2007 | Van De Ven |
| 2008/0235813 A1 | 9/2008 | Cooper et al. |
| 2008/0235815 A1 | 9/2008 | Cooper et al. |
| 2008/0247170 A1 | 10/2008 | Peck |
| 2010/0081789 A1 | 4/2010 | Cooper et al. |
| 2010/0099148 A1 | 4/2010 | Cooper et al. |
| 2010/0199366 A1 | 8/2010 | Cooper et al. |
| 2010/0261227 A1 | 10/2010 | Cooper |
| 2011/0162096 A1 | 6/2011 | Cooper et al. |

FOREIGN PATENT DOCUMENTS

| | | |
|---|---|---|
| EP | 1364205 B1 | 5/2007 |
| EP | 1700914 A1 | 9/2008 |
| EP | 1539785 | 5/2009 |
| EP | 1592789 | 5/2009 |
| EP | 2417263 | 2/2012 |
| JP | 2000512149 | 9/2000 |
| JP | 2001513336 | 9/2001 |
| JP | 2002238559 | 8/2002 |
| WO | WO-9220316 | 11/1992 |
| WO | WO-9324626 | 12/1993 |
| WO | WO-9420608 | 9/1994 |
| WO | WO-9531566 | 11/1995 |
| WO | WO-9747739 | 12/1997 |
| WO | WO-9909817 | 3/1999 |

(56) References Cited

FOREIGN PATENT DOCUMENTS

| | | |
|---|---|---|
| WO | WO-9919472 | 4/1999 |
| WO | WO-9940213 | 8/1999 |
| WO | WO-9942569 | 8/1999 |
| WO | WO-0011151 | 3/2000 |
| WO | WO-0023579 | 4/2000 |
| WO | WO-0030437 | 6/2000 |
| WO | WO-0056932 | 9/2000 |
| WO | WO-0114537 | 3/2001 |
| WO | WO-0117344 | 3/2001 |
| WO | WO-0119846 | 3/2001 |
| WO | WO-0123525 | 4/2001 |
| WO | WO-0126455 | 4/2001 |
| WO | WO-0143540 | 6/2001 |
| WO | WO-0171019 | 9/2001 |
| WO | WO-0173094 | 10/2001 |
| WO | WO-0183786 | 11/2001 |
| WO | WO-0185965 | 11/2001 |
| WO | WO 02/02738 A2 | 1/2002 |
| WO | WO-0246430 | 6/2002 |
| WO | WO-0247475 | 6/2002 |
| WO | WO-02063293 | 8/2002 |
| WO | WO-03014344 | 2/2003 |
| WO | WO-03024199 | 3/2003 |
| WO | WO-03025146 | 3/2003 |
| WO | WO-03048364 | 6/2003 |
| WO | WO-03064627 | 8/2003 |
| WO | WO 2004/003157 A2 | 1/2004 |
| WO | WO-2004009792 | 1/2004 |
| WO | WO-2004047531 | 6/2004 |
| WO | 2004067706 | 8/2004 |
| WO | WO-2004065581 | 8/2004 |
| WO | WO-2004067707 | 8/2004 |
| WO | WO-2004067743 | 8/2004 |
| WO | WO-2004080162 | 9/2004 |
| WO | WO-2004092351 | 10/2004 |
| WO | WO-2004110143 | 12/2004 |
| WO | WO-2005040215 | 5/2005 |
| WO | WO-2005062881 | 7/2005 |
| WO | WO-2005084430 | 9/2005 |
| WO | WO-2006024867 | 3/2006 |
| WO | WO-2006026238 | 3/2006 |
| WO | WO-2006053245 | 5/2006 |
| WO | WO-2006055040 | 5/2006 |
| WO | WO-2006055931 | 5/2006 |
| WO | WO-2006065821 | 6/2006 |
| WO | WO-2006093847 | 9/2006 |
| WO | 2007092537 | 8/2007 |
| WO | 2007110231 | 10/2007 |
| WO | WO 2010/036976 A2 | 4/2010 |
| WO | WO 2010/036978 A2 | 4/2010 |
| WO | WO 2010/036979 A2 | 4/2010 |
| WO | WO-2010118360 | 10/2010 |
| WO | 2012051615 | 4/2012 |

OTHER PUBLICATIONS

Maksimenko et al., "Insulators of higher eukaryotes: properties, mechanisms of action, and role in transcriptional regulation", Genetika vol. 42, No. 8, Aug. 2006, Abstract only.
International Search Report and Written Opinion of the International Searching Authority of PCT/US2009/058494, dated Apr. 14, 2010, 15 pages.
International Search Report and Written Opinion of the International Searching Authority of PCT/US2009/058497, dated Apr. 14, 2010, 14 pages.
Blatt et al., "Human variant interferon-alpha 2b protein Seq ID No. 1440", Database Geneseq [Online] Derwent: XP002601423-424, Dec. 13, 2007, 2 Pages.
Kwaks, T. H. et al., "Employing epigenetics to augment the expression of therapeutic proteins in mammalian cells", Trends in Biotechnology, Elsevier Publications, Cambridge, GB LNKDD0I: 10.1016/J.TIBTECH Mar. 1, 2006, pp. 137-142.
International Application Number PCT/US2009/058498, International Search Report and Written Opinion mailed on Oct. 6, 2010, 16 Pages.
International Application Number PCT/US2010/030589, International Search Report and Written Opinion, mailed on Sep. 24, 2010, 26 Pages.
Australian Patent Application No. 2003261096, Examiner's First Report, dated Jun. 7, 2007.
Australian Patent Application No. 2003261096, Response to Examiner's First Report, dated May 12, 2008.
Australian Patent Application No. 2003261096, Examiner's Second Report, dated Jun. 6, 2008.
Australian Patent Application No. 2003261096, Response to Examiner's Second Report, dated Sep. 8, 2008.
Australian Patent Application No. 2003261096, Notice of Acceptance, dated Sep. 25, 2008.
Canadian Patent Application No. 2,490,693, Office Action, mailed Oct. 5, 2009.
Canadian Patent Application No. 2,490,693, Response to Office Action, filed Apr. 1, 2010.
Canadian Patent Application No. 2,490,693, Response to Office Action, filed Nov. 4, 2010.
Canadian Patent Application No. 2,490,693, Office Action, dated Dec. 30, 2010 (2 pages).
Canadian Patent Application No. 2,490,693, Response to Office Action, filed Mar. 7, 2011.
Canadian Patent Application No. 2,490,693, Notice of Allowance, mailed Mar. 24, 2011.
European Patent Application No. 037621729, Supplementary Search Report, mailed Feb. 15, 2006.
European Patent Application No. 037621729, First Office Action, mailed Jun. 9, 2006.
European Patent Application No. 037621729, Response to First Office Action, filed Oct. 18, 2006.
European Patent Application No. 037621729, Second Office Action, mailed Nov. 23, 2006.
European Patent Application No. 037621729, Response to Second Office Action, filed Apr. 2, 2007.
European Patent Application No. 037621729, Third Office Action, mailed Apr. 24, 2007.
European Patent Application No. 037621729, Response to Third Office Action, filed Aug. 31, 2007.
European Patent Application No. 037621729, Fourth Office Action, mailed Oct. 10, 2007.
European Patent Application No. 037621729, Response to Fourth Office Action, filed Feb. 11, 2008.
European Patent Application No. 037621729, Fifth Office Action, mailed Feb. 26, 2008.
European Patent Application No. 037621729, Response to Fifth Office Action, filed Jul. 4, 2008.
European Patent Application No. 037621729, Communication Under Rule 71(3) EPC, mailed Nov. 11, 2008.
European Patent Application No. 038002259, Supplementary Partial Search Report, mailed May 26, 2006.
European Patent Application No. 038002259, Second Office Action, mailed Jun. 14, 2007.
European Patent Application No. 038002259, Response to Second Office Action, mailed Oct. 23, 2007.
European Patent Application No. 038002259, Third Office Action, mailed Nov. 7, 2007.
European Patent Application No. 038002259, Response to Third Office Action, filed Mar. 17, 2008.
European Patent Application No. 038002259, Fourth Office Action, mailed Mar. 31, 2008.
European Patent Application No. 038002259, Response to Fourth Office Action, filed May 30, 2008.
European Patent Application No. 038002259, Communication Under Rule 71(3) EPC, mailed Aug. 19, 2008.
European Patent Application No. 038085635, First Office Action, mailed Oct. 5, 2005.
European Patent Application No. 038085635, Response to First Office Action, filed Oct. 18, 2005.
European Patent Application No. 038085635, Search Report, mailed Jan. 23, 2007.
European Patent Application No. 038085635, Search Report, mailed Apr. 12, 2007.

(56) References Cited

OTHER PUBLICATIONS

European Patent Application No. 038085635, Second Office Action, mailed May 2, 2007.
European Patent Application No. 09815462.8, Communication Under Rule 161(1) and 162, mailed May 17, 2011.
Indian Patent Application No. 99/KOLNP/2005, First Official Action, mailed Jun. 17, 2006.
International Patent Application No. PCT/US2003/020389, International Search Report, mailed Apr. 2, 2004.
International Patent Application No. PCT/US2003/020389, Written Opinion, mailed Jun. 17, 2004.
International Patent Application No. PCT/US2003/041261, International Search Report, mailed Nov. 3, 2004.
International Patent Application No. PCT/US2003/041269, International Search Report, mailed May 18, 2004.
International Patent Application No. PCT/US2003/041335, International Search Report, mailed Nov. 3, 2004.
International Patent Application No. PCT/US2004/043092, International Search Report and Written Opinion, May 11, 2006.
International Patent Application No. PCT/US2009/058494, International Preliminary Report on Patentability, mailed Apr. 7, 2011 (7 pages).
International Patent Application No. PCT/US2009/058497, International Preliminary Report on Patentability, mailed Apr. 7, 2011 (7 pages).
International Patent Application No. PCT/US2009/058498, International Preliminary Report on Patentability, mailed Apr. 7, 2011 (7 pages).
International Patent Application No. PCT/US2010/030589, International Preliminary Report on Patentability (15 pages).
Japanese Patent Application No. 2004518011, First Office Action, mailed Sep. 8, 2009.
Japanese Patent Application No. 2004567449, First Office Action, mailed Dec. 1, 2009.
U.S. Appl. No. 10/583,812, Office Action, mailed Feb. 3, 2011 (11 pages).
U.S. Appl. No. 10/583,812, Notice of Allowance, mailed Oct. 11, 2011 (37 pages).
U.S. Appl. No. 10/609,019, Office Action, mailed Dec. 27, 2005 (15 pages).
U.S. Appl. No. 10/609,019, Office Action, mailed Jun. 26, 2006 (13 pages).
U.S. Appl. No. 10/609,019, Office Action, mailed Nov. 7, 2006 (11 pages).
U.S. Appl. No. 10/609,019, Office Action, mailed May 4, 2007 (12 pages).
U.S. Appl. No. 10/609,019, Office Action, mailed Oct. 17, 2007 (18 pages).
U.S. Appl. No. 10/609,019, Office Action, mailed Feb. 12, 2008 (26 pages).
U.S. Appl. No. 10/609,019, Notice of Allowance, mailed Jan. 9, 2009 (9 pages).
U.S. Appl. No. 10/746,149, Office Action, mailed Aug. 9, 2006 (38 pages).
U.S. Appl. No. 10/746,149, Office Action, mailed Feb. 28, 2007 (29 pages).
U.S. Appl. No. 10/746,149, Office Action, mailed Oct. 18, 2007 (21 pages).
U.S. Appl. No. 10/746,149, Office Action, mailed Feb. 8, 2008 (25 pages).
U.S. Appl. No. 10/746,149, Office Action, mailed Aug. 20, 2008 (31 pages).
U.S. Appl. No. 10/746,149, Office Action, mailed Feb. 3, 2009 (22 pages).
U.S. Appl. No. 11/981,574, Office Action, mailed Jan. 7, 2009 (19 pages).
U.S. Appl. No. 11/981,574, Office Action, mailed Jun. 24, 2009 (8 pages).
U.S. Appl. No. 11/981,574, Notice of Allowance, mailed Aug. 10, 2009 (7 pages).
U.S. Appl. No. 11/981,629, Office Action, mailed Feb. 5, 2009 (36 pages).
U.S. Appl. No. 11/981,629, Response to Non-Final Office Action, filed Aug. 5, 2009.
U.S. Appl. No. 11/981,629, Office Action, mailed Dec. 10, 2009 (23 pages).
U.S. Appl. No. 11/981,629, Response to Final Office Action, filed Feb. 10, 2010.
U.S. Appl. No. 11/981,629, Advisory Action, mailed Feb. 24, 2010.
U.S. Appl. No. 11/981,629, Request for Continued Examination and Amendment, filed May 10, 2010.
U.S. Appl. No. 11/981,629, Office Action, mailed Dec. 27, 2010 (19 pages).
U.S. Appl. No. 11/981,629, Response to Non-Final Office Action, filed May 17, 2011.
U.S. Appl. No. 11/981,629, Office Action, mailed Aug. 10, 2011 (15 pages).
U.S. Appl. No. 11/981,629, Response to Non-Final Office Action, filed Sep. 30, 2011.
U.S. Appl. No. 11/981,629, Office Action, mailed Dec. 30, 2011 (9 pages).
U.S. Appl. No. 12/567,334, Office Action, mailed Apr. 15, 2011 (30 pages).
U.S. Appl. No. 12/567,334, Office Action, mailed Oct. 6, 2011 (14 pages).
U.S. Appl. No. 12/757,591, Office Action, mailed Sep. 13, 2011 (4 pages).
U.S. Appl. No. 12/941,448, Office Action, mailed Oct. 19, 2011 (8 pages).
U.S. Appl. No. 11/981,629 , "Notice of Allowance", Jul. 11, 2012, 6 pages.
U.S. Appl. No. 12/567,214 , "Office Action", Dec. 7, 2012, 19 pages.
U.S. Appl. No. 12/567,214 , "Response to Non-Final Office Action", Oct. 1, 2012, 9 pages.
U.S. Appl. No. 12/757,591 , "Office Action", Dec. 28, 2012, 17 pages.
U.S. Appl. No. 12/757,591 , "Response to Non-Final Office Action", Oct. 2, 2012, 10 pages.
European Patent Application No. EP10715625.9 , "Office Action", Jul. 20, 2012, 6 pages.
European Patent Application No. EP10715625.9 , "Office Action", Jan. 28, 2014, 7 pages.
U.S. Appl. No. 11/981,629, "Response to Interview Summary" filed Mar. 19, 2012.
U.S. Appl. No. 12/567,214, "Office Action" mailed Apr. 2, 2012.
U.S. Appl. No. 12/567,334, "Request for Continued Examination and Response to Office Action" filed Apr. 3, 2012.
U.S. Appl. No. 12/567,334, "Response to Office Action" filed Feb. 6, 2012.
U.S. Appl. No. 12/567,334, "Response to Office Action" filed Jul. 13, 2011.
U.S. Appl. No. 12/941,448, "Response to Office Action" filed Feb. 23, 2012.
U.S. Appl. No. 12/941,448, "Supplemental Response to Office Action" filed Apr. 4, 2012.
European Application No. EP09815462.8, "Response to Office Action", filed Nov. 16, 2011.
European Application No. EP10715625.9, "Office Action", mailed Nov. 17, 2011.
European Application No. EP10715625.9, "Response to Office Action", filed Mar. 7, 2012.
U.S. Appl. No. 12/757,591, Office Action mailed Apr. 6, 2012 (12 pages).
U.S. Appl. No. 12/941,448, Notice of Allowance mailed Apr. 17, 2012 (13 pages).
U.S. Appl. No. 12/941,448, "Office Action", Mailed Nov. 25, 2011.
Canadian Patent Application No. 2,490,693, "Office Action", mailed May 4, 2010.
International Patent Application No. PCT/US2011/056562, "International Search Report and Written Opinion", mailed Jan. 27, 2012 (13 pages).

(56) References Cited

OTHER PUBLICATIONS

Schubeler, et al., "Scaffold/Matrix-Attached Regions Act upon Transcription in a Context-Dependent Manner", Biochemistry, 1996, 35: 11160-11169.
Abdel-Salam, H. A. et al., "Expression of mouse anticreatine kinase (MAK33) monoclonal antibody in the yeast Hansenula polymorpha", Applied Microbiology and Biotechnology 00/00/2001, Springer Verlag, Berlin, DE, vol. 56, 157-164.
Afanassieff, et al., "Intratesticular Inoculation of Avian Leukosis Virus (ALV) in Chickens—Production of", Avian Diseases Jan. 1, 1996, 841-852.
Alexeyev, M. et al., "Mini-TN10 Transposon Derivatives for Insertion Mutagenesis and Gene Delivery into the Chromosome of Gram-negative Bacteria", Gene 1995, vol. 160, pp. 59-62.
Andra, et al., "Generation and Characterization of Transgenic Mice Expressing Cobra Venom", Molecular Immunology 2002, vol. 39, 357-365.
Araki, et al., "Site-Specific Recombination of a Transgene in Fertilized Eggs by Transient", Proc. Natl. Acad. Sci. USA Jan. 1, 1995, vol. 92, 160-164.
Argaud, et al., "Regulation of Rat Liver Glucose-6-Phosphatase Gene Expression in Different", Diabetes Nov. 1, 1996, 1563-1571.
Awade, et al., "Comparison of Three Liquid Chromatographic Methods for Egg-White Protein", Journal of Chromatography B. Jan. 1, 1999, vol. 723, 69-74.
Awade, A. C., "On Hen Egg Fractionation: Applications of Liquid Chromatography to the Isolation and", Z Lebensm Unters Forsch Jan. 1, 1996, vol. 202, 1-14.
Beardsley, T., "Gene Therapy Setback: A Tragic Death Clouds the Future of an Innovative Treatment", Scientific American Jun. 11, 2001, No. 2.
Bell, et al., "Nucleotide Sequence of a cDNA Clone Encoding Human Preproinsulin", Nature Nov. 29, 1979, vol. 282, 525-527.
Bolli, et al., "Insulin Analogues and Their Potential in the Management of Diabetes Mellitus", Diabetologia Jan. 1, 1999, vol. 42, 1151-1167.
Brinster, R. L., "Germline Stem Cell Transplantation and Transgenesis", Science Jun. 21, 2002, vol. 296, 2174-2176.
Chatterjee, et al., "Retrofitting High Molecular Weight DNA Cloned in P1: Introduction of Reporter", Genetic Analysis: Biomolecular Jan. 1, 1996, vol. 13, 33-42.
Ciampi, M. S. et al., "Transposon Tn10 Provides a Promoter for Transcription of Adjacent Sequences", Proc Natl Acad Sci USA Aug. 1, 1982, vol. 79, No. 16, 5016-5020.
Ciftci, et al., "Applications of Genetic Engineering in Veterinary Medicine", Advanced Drug Delivery Reviews Jan. 1, 2000, vol. 43, 57-64.
Cochet, M et al., "Organisation and sequence studies of the 17-piece chicken conalbumin gene", Nature Dec. 6, 1979, vol. 282; 567-574.
Davis, C. G., "The Many Faces of Epidermal Growth Factor Repeats", New Biologist May 1990, 2(5), 410-419.
Davis, M. A. et al., "Tn10 Protects Itself at two levels from fortuitous activation by external promoters", Cell Nov. 11, 1985, vol. 43, No. 1, 379-387.
Dematteo, et al., "Engineering Tissue-Specific Expression of a Recombinant Adenovirus: Selective", Journal of Surgical Research Jan. 1, 1997, vol. 72, 155-161.
Desert, C. et al., "Comparisons of Different Electrophoretic Separations of Hen Egg White Proteins", J. Agric. Food Chem. Jan. 1, 2001, vol. 49, 4553-4561.
Dierich, A. et al., "Cell-Specificity of the Chicken ovalbumin and conalbumin promoters", EMBO. Journal 1987, 6(8), 2305-2312.
Dobeli, H. et al., "Recombinant Fusion Proteins for the Industrial Production of Disulfide Bridge Containing Peptides: Purification, Oxidation without Concatamer Formation, and Selective Cleavage", Protein Expression and Purification 1998, 12, 404-414.
Dong, et al., "Hepatic Insulin Production Type-1 Diabetes", Trends in Endocrinology & Dec. 1, 2001, vol. 12, 441-446.
Dunham, Rex A. et al., "Enhanced Bacterial Disease Resistance of Transgenic Channel Catfish Ictalurus punctatus Possessing Cecropin Genes", Marine Biotechnology 06/00/2002, Springer Verlag, New York, NY, US, vol. 4, No. 3, 38-344.
Dupuy, A. et al., "Mammalian Germ-like Transgenesis by Transposition", PNAS Apr. 2, 2002, vol. 99, 4495-4499.
Ebara, et al., "In Vivo Gene Transfer into Chicken Embryos via Primordial Germ Cells Using Green", Journal of Reproduction and Jan. 1, 2000, vol. 46, 79-83.
Ebara, et al., "Possible Abnormalities of Chimeric Chicken Caused by the Introduction of", Asian-Aus. J. Anim. Sci. Jan. 1, 2000, vol. 13, 1514-1517.
Eggleston, et al., "A Sensitive and Rapid Assay for Homologous Recombination in Mosquito Cells:", BMC Genetics Dec. 17, 2001, vol. 2, No. 21, 1-9.
Etches, et al., "Gene Transfer: Overcoming the Avian Problems (Abstract Provided)", Proceedings, 5th World Congress Aug. 1, 1994, vol. 20, 97-101.
Etches, et al., "Manipulation of the Avian Genome", Jan. 1, 1993, pp. 15-28, 81-101, 103-119, 121-133, 165-184, 205-222, 223-230.
Etches, R. J. et al., "Strategies for the Production of Transgenic Chicken", Methods in Molecular Biology Jan. 1, 1997, vol. 62, 433-450.
Falqui, et al., "Reversal of Diabetes in Mice by Implantation of Human Fibroblasts Genetically Engineered to release matures Human Insulin", Human Gene Therapy Jul. 20, 1999, vol. 10, 1753-1762.
Fischer, R. et al., "Antibody production by molecular farming in plants", Journal of Biological Regulators and Hoeostatic Agents 04/00/2000, Wichtig Editore, Milan, IT, vol. 14, No. 2, 83-92.
Fischer, S. et al., "Regulated Transposition of a Fish Transposon in the Mouse Germ Line", Proc. Natl. Acad. Sci. USA Jan. 1, 2001, vol. 98, No. 12, 6759-6764.
Fisher, et al., "Induction of Terminal Differentiation in Cancer Cells as a Therapeutic Modality for Suppressing Tumor Growth: Studies Employing Human Melanoma", Anticancer Research 1988, vol. 8 (5B), 1057.
Fong, K. P. et al., "The genes for benzene catabolism in Pseudomonas putida ML2 are flanked by two", Plasmid Mar. 1, 2000, vol. 43, No. 2, 103-110.
Gaub, Marie-Pierre et al., "The Chicken ovalbumin promoter is under negative control which is relieved by steroid hormones", EMBO. Journal 1987, 6(8), 2313-2320.
Ghosh, et al., "Liver-Directed Gene Therapy: Promises, Problems and Prospects at the Turn of the", Journal of Hepatology Jan. 1, 2000, vol. 32, 238-252.
Gibbins, A. M., "Chickens as Bioreactors—Harvesting Commercially-Valuable Proteins from the Egg", Agri-food Research in Ontario Jan. 1, 1996, 39-41.
Gibbins, et al., "Exploring the Product Possibilities Arising from Transgenic Poultry Technology", Kungl. Skogs—och Jan. 1, 1997, vol. 136, 57-68.
Gibbins, et al., "Genetically-Engineered Poultry", Lohmann Information Jan. 1, 1997, No. 21, 3-6.
Gibbins, A. M. V., "The Chicken, the Egg, and the Ancient Mariner", Nat. Biotechnol. Jan. 1, 1998, vol. 16, 1013-1014.
Gibbins, A. M. V., "Transgenic Poultry Technology and Food Production", Animal Biotechnology Jan. 1, 1998, vol. 9, No. 3, 173-179.
Giddings, Glynis, "Transgenic plants as protein factories", Current Opinion in Biotechnology, London, GB 10/00/2001, vol. 12, No. 5, 450-454.
Ginsberg, et al., "The Road Ahead for Biologics Manufacturing", Equity Research Jan. 1, 2002, 1-23.
Hackett, P. B. et al., "Development of Genetic Tools for Transgenic Animals", Transgenic Animals in Agriculture Jan. 1, 1999, 19-35.
Han, et al., "Gene Transfer by Manipulation of Primordial Germ Cells in the Chicken", AJAS Jan. 1, 1994, vol. 7, No. 3, 427-434.
Harvey, A. et al., "Expression of Exogenous Protein in the White Egg of Transgenic Chickens", Nature Biotechnology Apr. 1, 2002, vol. 19, 396-399.
Heilig, R. et al., "NCBI Accession No. V00437—Gallus Gallus Fragment of Ovalbumin Gene Coding for the First Leader Exon", 1997.
Heilig, R. et al., "The Ovalbumin Gene Family, the 5' End Region of the X and Y Genes", J. Mol. Bio 1982, vol. 156, No. 1, pp. 1-19.

(56) References Cited

OTHER PUBLICATIONS

Hermann, et al., "Lipoprotein Receptors in Extraembryonic Tissues of the Chicken", J. Biol. Chem. Jun. 2, 2000, vol. 275, 16837-16844.
Herrero, M. et al., "Transposon Vectors containing Non-Antibiotic Resistance Selection Markers for Cloning and Stable Chromosomal Insertion of Foreign Genes in Gram-Negative Bacteria", Journal of Bacteriology 1990, vol. 172, No. 11, pp. 6557-6567.
Hillel, et al., "Strategies for the Rapid Introgression of a Specific Gene Modification into a", Poultry Science Jan. 1, 1993, vol. 72, 1197-1211.
Hong, et al., "Improved Transfection Efficiency of Chicken Gonadal Primordial Germ Cells for the", Transgenic Research Jan. 1, 1998, vol. 7, 247-252.
Horn, et al., "A Versatile Vector Set for Animal Transgenesis", Development Genes and Evolution 2000, vol. 210, No. 12, 630-637.
Houdebine, L. M., "The Methods to Generate Transgenic Animals and to Control Transgene Expression", J. Biotechnol. Sep. 25, 2002, vol. 98, 145-160.
Houdebine, L. M., "Transgenic Animal Bioreactors", Transgenic Research Oct. 1, 2000, vol. 9, No. 4-5, 305-320.
Ivarie, et al., "Avian Transgenesis: Progress Towards the Promise", Trends in Biotech Jan. 1, 2003, vol. 21, No. 1, 14-19.
Izsvak, et al., "Sleeping Beauty, a Wide Host-Range Transposon Vector for Genetic Transformation", J. Mol. Biol. Jan. 1, 2000, vol. 302, 93-102.
Jarvis, et al., "Influence of Different Signal Peptides and Prosequences on Expression and", The Journal of Biological Chemistry Aug. 5, 1993, vol. 268, No. 22, 16754-16762.
Jeltsch, et al., "The Complete Nucleotide Sequence of the Chicken Ovotransferrin mRNA", Eur.J. Biochem 1982, 122, 291-295.
Kaminski, et al., "Design of a Nonviral Vector for Site-Selective, Efficient Integration into the Human", The FASEB Journal Aug. 1, 2002, vol. 16, 1242-1247.
Kanda, et al., "Genetic Fusion of an a-Subunit Gene to the Follicle-Stimulating Hormone and", Molecular Endocrinology Nov. 1, 1999, vol. 13, No. 11, 1873-1881.
Kay, Mark A. et al., "Viral vectors for gene therapy: the art of turning infectious agents into vehicles of therapeutics", Nature Medicine Jan. 2001, vol. 7 No. 1, 33-40.
Kleckner, N. et al., "Transposon Tn10: genetic organization, regulation and insertion specificity", Fed Proc Aug. 1, 1982, vol. 41, No. 10, 2649-2652.
Kluin, PH. M. et al., "Proliferation of Spermatogonia and Sertoli Cells in Maturing Mice", Anat. Embryol. Jan. 1, 1984, vol. 169, 73-78.
Koga, et al., "The Medaka Fish Tol2 Transposable Element can Undergo Excision in Human and", J Hum Genet Mar. 28, 2003, vol. 48, No. 5, 231-235.
Kousteni, et al., "Reversal of Bone Loss in Mice by Nongenotypic Signaling of Sex Steroids", Science Oct. 25, 2002, vol. 298, 843-846.
Kozak, M, "At Least Six Nucleotides Preceding the AUG Initiator Codon Enhance Translation in", J. Mol. Biol. 1987, vol. 196, 947-950.
Kozak, M., "Initiation of translation in prokaryotes and eukaryotes", Gene 1999, vol. 234, 187-208.
Kumaran, J. D. S. et al., "The Normal Development of the Testes in the White Plymouth Rock", Testis Development in White Jan. 1, 1948, 511-519.
Lampe, D. et al., "Hyperactive transposase mutants of the Himar1 mariner transposon", Proc. Natl. Acad. Sci. USA Sep. 1, 1999, vol. 96, 11428-11433.
Lillico, et al., "Transgenic Chickens as Bioreactors for Protein-Based Drugs", Drug Discovery Today Feb. 2005, vol. 10, No. 3, pp. 191-196.
Marshak, S. et al., "Purification of the Beta-Cell Glucose-sentitive factor that Transactivates the Insulin", Proc. Natl. Acad. Sci. USA Dec. 1, 1996, vol. 93, 15057-15062.
Massoud, et al., "The Deleterious Effects of Human Erythropoietin Gene Driven by the Rabbit Whey Acidic Protein Gene Promoter in Transgenic Rabbits", Reprod Nutr Dev 1996, 36(5), 555-563.

Mather, et al., "The Mariner Transposable Element: A Potential Vector for Improved Integration of", British Poulty Science Sep. 1, 2000, vol. 41, S27-S28.
Meiss, et al., "Vectors for Dual Expression of Target Genes in Bacterial and Mammalian Cells", BioTechniques 2000, vol. 29, No. 3, 476, 478, 480.
Mohammed, et al., "Deposition of Genetically Egineered Human Antibodies into the Egg Yolk of Hens", Immunotechnology 1998, vol. 4, 115-125.
Monroe, D. et al., "The COUP-Adjacent Repressor (CAR) Element Participates in the Tissue-Specific", Biochemica et Biophysica Acta Jan. 1, 2000, vol. 1517, 27-32.
Mozdziak, et al., "Status of Transgenic Chicken Models for Developmental Biology", Developmental Dynamics 2004, 229:414-421.
Muramatsu, T. et al., "Regulation of Ovalbumin Gene Expression", Poultry and Avian Biology Jan. 1, 1995, vol. 6, No. 2, 107-123.
Muzzin, et al., "Hepatic Insulin Gene Expressions as Treatment for a Type 1 Diabetes Mellitus in Rats", Mol Endo Jan. 1, 1997, vol. 11, 833-837.
Nicklin, et al., "Analysis of Cell-Specific Promoters for Viral Gene Therapy Targeted at the Vascular", Hypertension Jan. 1, 2001, vol. 38, 65-70.
Oakberg, E., "Duration of Spermatogenesis in the Mouse and Timing of Stages of the Cycle of the", Duration of Spermatogenesis, 507-516.
Ochiai, H. et al., "Synthesis of Human Erythropoietin in Vivo in the Oviduct of Laying Hens by", Poultry Science 1998, vol. 77, No. 2, 299-302.
Ono, T. et al., "Gene Transfer into Circulating Primorial Germ Cells of Quail Embryos", Exp. Anim. Jan. 1, 1995, vol. 4, No. 4, 275-278.
Osborne, et al., "A System for Insertional Mutagenesis and Chromosomal Rearrangement Using the", Plant J. Apr. 1, 1995, vol. 7, No. 4, 687-701.
Pain, B. et al., "Chicken Embryonic Stem Cells and Transgenic Strategies", Cell Tissues Organs 1999, vol. 165, 212-219.
Park, H., "COUP-TF Plays a Dual Role in the Regulation of the Ovalbumin Gene", Biochemistry Jan. 1, 2000, vol. 39, 8537-8545.
Phan, J. et al., "Structural Basis for the Substrate Specificity of Tobacco Etch Virus Protease", Journal of Biological Chemistry Dec. 27, 2002, vol. 277, 50564-50572.
Pieper, et al., "Restoration of Vascular Endothelial Function in Diabetes", Diabetes Res. Clin. Pract. Suppl. 1996, S157-S162.
Platon, D. et al., "A Shortage of Monoclonal Antibody Manufacturing Capacity", Pharmaceutical Fine Chemicals and BioMolecule Manufacturing Report 2002.
Prudhomme, M. et al., "Diversity of Tn4001 transposition products: the flanking IS256 elements can form", J Bacteriol Jan. 1, 2002, vol. 184, No. 2, 433-443.
Qiu, Y., "Spatiotemporal Expression Patterns of Chicken Ovalbumin Upstream Promoter-", Proc. Natl. Acad. Sci. Jan. 1, 1994, vol. 91, 4451-4455.
Richardson, P. D., "Gene Repair and Transposon-Mediated Gene Therapy", Stem Cells 2002, vol. 20, 112-115.
Sakai, J. et al., "Two classes of Tn10 transposase mutants that suppress mutations in the Tn10", Genetics Nov. 1, 1996, vol. 144, No. 3, 861-870.
Sang, et al., "Prospects for Transgenesis in the Chick", Mech. Dev. 2004, 121(9): 1179-86.
Sarmasik, Aliye et al., "Transgenic live-bearing fish and crustaceans produced by transforming immature", Marine Biotechnology 00/00/2001, vol. 3, No. 5, 470-477.
Sasakawa, C. et al., "Control of transposon Tn5 transposition in *Escherichia coli*", Prod Natl Acad Sci USA Dec. 1, 1982, vol. 79, No. 23, 7450-7454.
Schillberg, Stefan et al., "Apoplastic and cytosolic expression of full-size antibodies and antibody fragments in Nicotiana tabacum", Transgenic Research 08/00/1999, vol. 8, No. 4, 255-263.
Schillberg, S. et al., "Molecular farming of recombinant antibodies in plants", CMLS Cellular and Molecular Life Sciences 03/00/2003, Birkhauser Verlag, Heidelberg, DE, vol. 60, No. 3, 433-445.
Schlenstedt, et al., "Structural Requirements for Transport of Preprocecropin A and Related Presecretory", The Journal of Biological Chemistry Dec. 5, 1992, vol. 236, No. 34, 24328-24332.

(56) References Cited

OTHER PUBLICATIONS

Schneider, et al., "An Epitope Tagged Mammalian / Prokaryotic Expression Vector with Positive", Gene: An International Journal on 1997, vol. 197, 337-341.
Schultz, et al., "Translation Initiation of IS50R Read-through Transcripts", J. Mol. Biol 1991, vol. 221, 65-80.
Seal, et al., "Mutational Studies Reveal a Complex Set of Positive and Negative Control Elements", Mol. Cell Biol. May 1, 1991, vol. 11, 2704-2717.
Sekine, Y. et al., "DNA Sequences required for translational frameshifting in production of the", Mol Gen Genet Nov. 1, 1992, vol. 235, No. 2-3, 325-332.
Sekine, Y. et al., "Identification of the site of translational frameshifting required for production of the", Mol Gen Genet Nov. 1, 1992, vol. 235, No. 2-3, 317-324.
Sharma, S. et al., "Pancreatic Islet Expression of the Homeobox Factor STF-1 Relies on and E-box", Journal of Biological Chemistry Jan. 26, 1996, vol. 271, 2294-2299.
Sherman, et al., "Transposition of the Drosophila Element Mariner into the Chicken Germ Line", Nature Biotechnology Nov. 1998, vol. 16, 1050-1053.
Sherratt, D., "Tn3 and Related Transposable Elements: Site-Specific Recombination and", Mobile DNA Jan. 1, 1989, 163-184.
Simons, R. W. et al., "Translational Control of IS10 Transposition", Cell Sep. 1, 1983, vol. 34, No. 2, 683-691.
Skolnick, J. et al., "From Genes to Protein structure and function: novel applications of computational approaches in the genomic era", Trends in Biotech. 2000, 18:34-39.
Slowinski, et al., "Pattern of Prepo-Endothelin-1 Expression Revealed by Reporter-Gene Activity in", Clinical Science, vol. 103, No. 48, 445-475.
Telmer, et al., "Epitope Tagging Genomic DNA Using a CD-Tagging Tn10 Minitransposon", Bio Techniques, 2002, vol. 32, No. 2, 422-430.
Vilen, et al., "Construction of Gene-Targeting Vectors: a Rapid Mu in vitro DNA Transposition-", Transgenic Research Jan. 1, 2001, vol. 10, 69-80.
Von Specht, M., "English translation of Dissertation entitled Expression of a recombinant human protein in vitro and in vivo in oviduct cells of chickens, with human erythroprotein (hrEPO) as an example", 2002, pp. 49-68.
Von Specht, M., "Expression eines rekombinanten humanen Proteins in vitro und in vivo in", Dissertation 2002, 49-68.
Wallace, et al., Biology the Science of Life 1986, vol. 2, 235.
Wang, A. et al., "Activation of silent genes by transposons Tn5 and Tn10.", Genetics Dec. 1, 1988, vol. 120, No. 4, 875-885.
Williamson, et al., "Expression of the Lysostaphin Gene of Staphyloccocus Simulans in a Eukaryotic System", Appl. Environ. Microbil. Mar. 1994, 60(3), 771-776.
Xanthopoulos, etal., "The structure of the gene for cecropin B, an antibacterial immune protein from", European Journal of Biochemistry 1988 , vol. 172, 371-376.
Zagoraiou, L., "In vivo Transposition of Minos, a Drosophila Mobile Element, in Mammalian Tissues", Proc. Natl. Acad. Sci. USA Jan. 1, 2001, vol. 98, No. 20, 11474-11478.
Zhukova, et al., "Expression of the Human Insulin Gene in the Gastric G Cells of Transgenic Mice", Transgenic Research 2001, vol. 10, 329-338.
U.S. Appl. No. 12/567,334 , "Non-Final Office Action", Sep. 12, 2014, 17 pages.
U.S. Appl. No. 12/757,591 , "Non Final Office Action", Oct. 8, 2014, 16 pages.
European Patent Application No. EP10715625.9 , Office Action mailed Sep. 10, 2014.

* cited by examiner

US 9,157,097 B2

VECTORS FOR PRODUCTION OF GROWTH HORMONE

PRIOR RELATED APPLICATIONS

The present application claims the benefit of priority to U.S. Provisional Application No. 61/100,157 filed Sep. 25, 2008 and U.S. Provisional Application No. 61/231,575 filed Aug. 5, 2009, both of which are hereby incorporated by reference in their entirety.

FIELD OF THE INVENTION

The present disclosure relates to compositions and methods for the production of growth hormone (GH). In particular, the disclosure relates to transposon based vectors and their use in methods for the efficient expression of GH.

BACKGROUND OF THE INVENTION

Manufacture of therapeutic proteins, such as GH, is an expensive process. Companies using recombinant techniques to manufacture GH are working at capacity and usually have a long waiting list to access their fermentation facilities. What is needed is a new, efficient, and economical approach to make GH in vitro or in vivo.

SUMMARY

The present invention addresses these needs by providing novel compositions which can be used for production of GH. These novel compositions include components of vectors such as vector backbones (SEQ ID NOs:1-13), novel promoters (SEQ ID NOs:14-15), and a gene of interest that encodes for GH. The present vectors comprise an insulator element located between the transposon insertion sequences and the multicloning site on the vector. In one embodiment, the insulator element is selected from the group consisting of an HS4 element, a lysozyme replicator element, a combination of a lysozyme replicator element and an HS4 element, and a matrix attachment region element. The vectors comprising each of these vector components are shown in SEQ ID NOs: 17-39. In one embodiment these vectors are transposon-based vectors. The present invention also provides methods of making these compositions and methods of using these compositions for the production of GH in vitro or in vivo. In one embodiment the GH is human (h)GH. These vectors have been used to transfect germline cells of birds through cardiac injection. The transgene in these vectors has been successfully passed through two generations of offspring, demonstrating stable integration and inheritance of the transgene.

Prokaryotic cells or eukaryotic cells may be transfected. It is to be understood that different cells may be transfected in vitro or in vivo with one of the presently disclosed compositions, provided the cells contain protein synthetic biochemical pathways for the expression of GH. For example, both prokaryotic cells and eukaryotic cells may be transfected with one of the disclosed compositions. In certain embodiments, animal or plant cells are transfected. Animal cells are preferred cells and include, for example, mammalian cells and avian cells. Animal cells that may be transfected include, but are not limited to, Chinese hamster ovary (CHO) cells, CHO-K1 cells, chicken embryonic fibroblasts, HeLa cells, Vero cells, FAO (liver cells), human 3T3 cells, A20 cells, EL4 cells, HepG2 cells, J744A cells, Jurkat cells, P388D1 cells, RC-4B/c cells, SK—N—SH cells, Sp2/mIL-6 cells, SW480 cells, 3T6 Swiss cells, human ARPT-19 (human pigmented retinal epithelial) cells, LMH cells, LMH2a cells, tubular gland cells, or hybridomas. Avian cells include, but are not limited to, LMH, LMH2a cells, chicken embryonic fibroblasts, and tubular gland cells.

In one embodiment, avian cells are transfected with one of the disclosed compositions. In a specific embodiment, avian hepatocytes, hepatocyte-related cells, or tubular gland cells are transfected. In certain embodiments, chicken cells are transfected with one of the disclosed compositions. In one embodiment, chicken tubular gland cells, chicken embryonic fibroblasts, chicken LMH2A or chicken LMH cells are transfected with one of the disclosed compositions. Chicken LMH and LMH2A cells are chicken hepatoma cell lines; LMH2A cells have been transformed to express estrogen receptors on their cell surface.

In other embodiments, mammalian cells are transfected with one of the disclosed compositions. In one embodiment, Chinese hamster ovary (CHO) cells, ARPT-19 cells, HeLa cells, Vero cells, FAO (liver cells), human 3T3 cells, or hybridomas are transfected for GH production. In a specific embodiment, CHO-K1 cells or ARPT-19 cells are transfected with one of the disclosed compositions.

The present invention provides compositions and methods for efficient production of GH, particularly hGH, in vitro or in vivo. This method enables production of large quantities of GH in vitro. Large quantities of GH include amounts in the gram and kilogram range, depending on the capacity of the culture method employed. These vectors may also be used in vivo to transfect germline cells in birds which can be bred and pass the transgene through several generations. These vectors also may be used for the production of GH in vivo, for example, for deposition in an egg.

DETAILED DESCRIPTION OF PREFERRED EMBODIMENTS OF THE INVENTION

Figure 1:
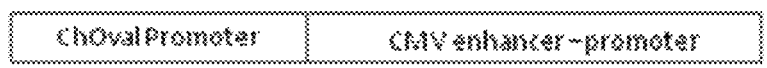
FIG. 1 presents a schematic representation of the construction of SEQ ID NO:14.

The present invention provides novel vectors and vector components for use in GH production. In one embodiment, the vectors are used for transfecting cells for GH production in vitro. In another embodiment, the vectors are used for transfecting cells for GH production in vivo. The present invention also provides methods to make these vector components, the vectors themselves, and methods for using these vectors to transfect cells so these cells produce GH in vitro. Any cell with protein synthetic capacity may be used. It is to be understood that different cells may be transfected in vitro or in vivo with one of the presently disclosed compositions, provided the cells contain protein synthetic biochemical pathways for the expression of the GH gene. For example, both prokaryotic cells and eukaryotic cells may be transfected with one of the disclosed compositions. In certain embodiments, animal or plant cells are transfected. Animal cells are preferred cells and include, for example, mammalian cells and avian cells. Cells that may be transfected include, but are not limited to, Chinese hamster ovary (CHO) cells, chicken embryonic fibroblasts, HeLa cells, Vero cells, FAO cells (liver cells), human 3T3 cells, A20 cells, EL4 cells, HepG2 cells, J744A cells, Jurkat cells, P388D1 cells, RC-4B/c cells, SK—N—SH cells, Sp2/mL-6 cells, SW480 cells, 3T6 Swiss cells, CHO-K1 cells, ARPE-19 cells, LMH cells, LMH2a cells, tubular gland cells, or hybridomas. Avian cells include, but are not limited to, LMH, LMH2a cells, chicken embryonic fibroblasts, and tubular gland cells. In one embodiment, avian cells are transfected with one of the disclosed compositions. In a specific embodiment, avian hepatocytes, hepatocyte-related cells, or tubular gland cells are transfected. In certain embodiments, chicken cells are transfected with one of the disclosed compositions. In one embodiment, chicken tubular gland cells, chicken embryonic fibroblasts, chicken LMH2A or chicken LMH cells are transfected with one of the disclosed compositions. Chicken LMH and LMH2A cells are chicken hepatoma cell lines; LMH2A cells have been transformed to express estrogen receptors on their cell surface.

In other embodiments, mammalian cells are transfected with one of the disclosed compositions. In one embodiment, CHO cells, HeLa cells, Vero cells, FAO cells (liver cells), human 3T3 cells, or hybridomas are transfected.

These vectors may also be used in vivo to produce transgenic animals by transfecting germline cells in animals such as birds which can be bred and then which pass the transgene encoding GH through several generations. These vectors also may be used in vivo to transform cells such as secretory cells to produce GH, for example, for deposition into an egg of the bird.

In one embodiment, the vectors of the present invention contain a gene encoding for GH production, particularly hGH production, by transfected cells. As used herein, the term growth hormone refers to GH protein that is encoded by a gene that is either a naturally occurring or a codon-optimized gene. As used herein, the term "codon-optimized" means that the DNA sequence has been changed such that where several different codons code for the same amino acid residue, the sequence selected for the gene is the one that is most often utilized by the cell in which the gene is being expressed. For example, in some embodiments, the gene of interest is expressed in LMH or LMH2A cells and includes codon sequences that are preferred in that cell type.

A. Vectors & Vector Components

The following paragraphs describe the novel vector components and vectors employed in the present invention.

1. Backbone Vectors

The backbone vectors provide the vector components minus the gene of interest (GOI) that encodes GH. In one embodiment, transposon-based vectors are used. The present vectors further comprise an insulator element located between the transposon insertion sequences and the multi-cloning site on the vector. In one embodiment, the insulator element is selected from the group consisting of an HS4 element, a lysozyme replicator element, a combination of a lysozyme replicator element and an HS4 element, and a matrix attachment region element.

a. Transposon-Based Vector Tn-MCS #5001 (p5001) (SEQ ID NO:1)

Linear sequences were amplified using plasmid DNA from pBluescriptII sk(−) (Stratagene, La Jolla, Calif.), pGWIZ (Gene Therapy Systems, San Diego, Calif.), pNK2859 (Dr. Nancy Kleckner, Department of Biochemistry and Molecular Biology, Harvard University), and synthetic linear DNA constructed from specifically designed DNA Oligonucleotides (Integrated DNA Technologies, Coralville, Iowa). PCR was set up using the above referenced DNA as template, electrophoresed on a 1% agarose gel, stained with ethidium bromide, and visualized on an ultraviolet transilluminator. DNA bands corresponding to the expected size were excised from the gel and purified from the agarose using Zymo Research's Clean Gel Recovery Kit (Orange, Calif.). The resulting products were cloned into the Invitrogen's PCR Blunt II Topo plasmid (Carlsbad, Calif.) according to the manufacturer's protocol.

After sequence verification, subsequent clones were selected and digested from the PCR Blunt II Topo Vector (Invitrogen Life Technologies, Carlsbad, Calif.) with corresponding enzymes (New England Biolabs, Beverly, Mass.) according to the manufacturer's protocol. The linear pieces were ligated together using Stratagene's T4 Ligase Kit (La Jolla, Calif.) according to the manufacturer's protocol. Ligated products were transformed into *E. coli* Top10 cells (Invitrogen Life Technologies, Carlsbad, Calif.) using chemical transformation according to the manufacturer's protocol. Transformed bacterial cells were incubated in 1 ml of SOC (GIBCO BRL, CAT#15544-042) for 1 hour at 37° C. then spread to LB (Luria-Bertani) agar plates supplemented with 100 ng/ml ampicillin (LB/amp plates). These plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining Colonies producing a plasmid of the expected size were cultured in a minimum of 250 ml of LB/amp broth. Plasmid DNA was harvested using Qiagen's Maxi-Prep Kit according to the manufacturer's protocol (Chatsworth, Calif.). The DNA was used as a sequencing template to verify that the pieces were ligated together accurately to form the desired vector sequence. All sequencing was performed using Beckman Coulter's CEQ 8000 Genetic Analysis System. Once a clone was identified that consisted of the desired sequence, the DNA was isolated for use in cloning in specific genes of interest.

b. Preparation of Transposon-Based Vector TnX-MCS #5005 (p5005)

This vector (SEQ ID NO:2) is a modification of p5001 (SEQ ID NO:1) described above in section 1.a. The multiple cloning site (MCS) extension was designed to add unique restriction sites to the MCS of the pTn-MCS vector (SEQ ID NO:1), creating pTnX-MCS (SEQ ID NO:2), in order to increase the ligation efficiency of constructed cassettes into the backbone vector. The first step was to create a list of all non-cutting enzymes for the current pTn-MCS DNA sequence (SEQ ID NO:1). A linear sequence was designed using the list of enzymes and compressing the restriction site sequences together. Necessary restriction site sequences for XhoI and PspOMI (New England Biolabs, Beverly, Mass.) were then added to each end of this sequence for use in splicing this MCS extension into the pTn-MCS backbone (SEQ ID NO:1). The resulting sequence of 108 bases is SEQ ID NO:16 shown in the Appendix. A subset of these bases within this 108 base pair sequence corresponds to bases 4917-5012 in SEQ ID NO:4 (discussed below).

For construction, the sequence was split at the NaRI restriction site and divided into two sections. Both 5' forward and 3' reverse oligonucleotides (Integrated DNA Technologies, San Diego, Calif.) were synthesized for each of the two sections. The 5' and 3' oligonucleotides for each section were annealed together, and the resulting synthetic DNA sections were digested with Nan then subsequently ligated together to form the 108 bp MCS extension (SEQ ID NO:16). PCR was set up on the ligation, electrophoresed on a 1% agarose gel, stained with ethidium bromide, and visualized on an ultraviolet transilluminator. DNA bands corresponding to the expected size were excised from the gel and purified from the agarose using a Zymo Clean Gel Recovery Kit (Zymo Research, Orange, Calif.). The resulting product was cloned into the PCR Blunt II Topo Vector (Invitrogen Life Technologies, Carlsbad, Calif.) according to the manufacturer's protocol.

After sequence verification of the MCS extension sequence (SEQ ID NO:16), a clone was selected and digested from the PCR Blunt II Topo Vector (Invitrogen Life Technologies, Carlsbad, Calif.) with XhoI and PspoMI (New England Biolabs, Beverly, Mass.) according to the manufacturer's protocol. The pTn-MCS vector (SEQ ID NO:1) also was digested with XhoI and PspOMI (New England Biolabs, Beverly, Mass.) according to the manufacturer's protocol, purified as described above, and the two pieces were ligated together using Stratagene's T4 Ligase Kit (La Jolla, Calif.) according to the manufacturer's protocol. Ligated product was transformed into E. coli Top10 cells (Invitrogen Life Technologies, Carlsbad, Calif.) using chemical transformation according the manufacturer's protocol. Transformed bacterial cells were incubated in 1 ml of SOC (GIBCO BRL, CAT#15544-042) for 1 hour at 37° C. then spread onto LB agar plates supplemented with 100 µg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in a minimum of 250 mls of LB/amp broth. Plasmid DNA was harvested using a Qiagen Maxi-Prep Kit (column purification) according to the manufacturer's protocol (Qiagen, Inc., Chatsworth, Calif.). The DNA was then used as a sequencing template to verify that the changes made in the vector were the desired changes and that no further changes or mutations occurred. All sequencing was performed using Beckman Coulter's CEQ 8000 Genetic Analysis System. Once a clone was identified that contained the multiple cloning site extension, the DNA was isolated and used for cloning specific genes of interest.

c. Preparation of Transposon-Based Vector TnHS4FBV #5006 (p5006)

This vector (SEQ ID NO:3) is a modification of p5005 (SEQ ID NO:2) described above in section 1.b. The modification includes insertion of the HS4 βeta globin insulator element on both the 5' and 3' ends of the multiple cloning site. The 1241 bp HS4 element was isolated from chicken genomic DNA and amplified through polymerase chain reaction (PCR) using conditions known to one skilled in the art. The PCR product was electrophoresed on a 1% agarose gel, stained with ethidium bromide, and visualized on an ultraviolet transilluminator. DNA bands corresponding to the expected size of the HS4 βeta globin insulator element were excised from the agarose gel and purified using a Zymo Clean Gel Recovery Kit (Zymo Research, Orange, Calif.).

Purified HS4 DNA was digested with restriction enzymes NotI, XhoI, PspOMI, and MluI (New England Biolabs, Beverly, Mass.) according to the manufacturer's protocol. The digested DNA was then purified using a Zymo DNA Clean and Concentrator kit (Orange, Calif.). To insert the 5' HS4 element into the MCS of the p5005 vector (SEQ ID NO:2), HS4 DNA and vector p5005 (SEQ ID NO:2) were digested with NotI and XhoI restriction enzymes, purified as described above, and ligated using Stratagene's T4 Ligase Kit (La Jolla, Calif.) according to the manufacturer's protocol. To insert the 3' HS4 element into the MCS of the p5005 vector (SEQ ID NO:2), HS4 and vector p5005 DNA (SEQ ID NO:2) were digested with PspOMI and MluI, purified, and ligated as described above. Ligated product was transformed into E. coli Top10 cells (Invitrogen Life Technologies, Carlsbad, Calif.) using chemical transformation according to the manufacturer's protocol. Transformed bacterial cells were incubated in 1 ml of SOC (GIBCO BRL, CAT#15544-042) for 1 hour at 37° C. then spread onto LB agar plates supplemented with 100 µg/ml ampicillin (LB/amp plates). These plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in at least 250 mls of LB/amp broth and plasmid DNA was harvested using a Qiagen Maxi-Prep Kit according to the manufacturer's protocol (Qiagen, Inc., Chatsworth, Calif.). The DNA was then used as sequencing template to verify that any changes made in the vector were the desired changes and that no further changes or mutations occurred. All sequencing was performed using Beckman Coulter's CEQ 8000 Genetic Analysis System. Once a clone was identified that contained both HS4 elements, the DNA was isolated and used for cloning in specific genes of interest.

All plasmid DNA was isolated by standard procedures. Briefly, E. coli bacteria containing the plasmid of interest were grown in 500 ml of LB broth (supplemented with an appropriate antibiotic) at 37° C. overnight in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

d. Preparation of Transposon-Based Vector pTn10 HS4FBV #5012

This vector (SEQ ID NO:4) is a modification of p5006 (SEQ ID NO:3) described above under section 1.c. The modification includes a base pair substitution in the transposase gene at base pair 1998 of p5006. The corrected transposase gene was amplified by PCR from template DNA, using PCR conditions known to one skilled in the art. PCR product of the corrected transposase was electrophoresed on a 1% agarose gel, stained with ethidium bromide, and visualized on an ultraviolet transilluminator. DNA bands corresponding to the expected size were excised from the gel and purified from the agarose using a Zymo Clean Gel Recovery Kit (Zymo Research, Orange, Calif.).

Purified transposase DNA was digested with restriction enzymes NruI and StuI (New England Biolabs, Beverly, Mass.) according to the manufacturer's protocol. Digested DNA was purified from restriction digests using a Zymo DNA Clean and Concentrator kit (Zymo Research). To insert the corrected transposase sequence into the MCS of the p5006 vector (SEQ ID NO:3), the transposase DNA and the p5006 vector (SEQ ID NO:3) were digested with NruI and StuI, purified as described above, and ligated using a Stratagene's T4 Ligase Kit (La Jolla, Calif.) according to the manufacturer's protocol. Ligated product was transformed into E. coli Top10 cells (Invitrogen Life Technologies, Carlsbad, Calif.) using chemical transformation according to the maunfacturer's protocol. Transformed cells were incubated in 1 ml of SOC (GIBCO BRL, CAT#15544-042) for 1 hour at 37° C. before spreading onto LB agar plates supplemented with 100 μg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in at least 250 ml of LB/amp broth. The plasmid DNA was harvested using a Qiagen Maxi-Prep Kit according to the manufacturer's protocol (Qiagen, Inc., Chatsworth, Calif.). The DNA was then used as a sequencing template to verify that the changes made in the vector were desired changes and that no further changes or mutations occurred. All sequencing was performed using a Beckman Coulter CEQ 8000 Genetic Analysis System. Once a clone was identified that contained the corrected transposase sequence, the DNA was isolated and used for cloning in specific genes of interest.

All plasmid DNA was isolated by standard procedures. Briefly, E. coli bacteria containing the plasmid of interest was grown in 500 mL of LB broth (supplemented with an appropriate antibiotic) at 37° C. overnight in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 μL of PCR-grade water and stored at −20° C. until needed.

e. Preparation of Transposon-Based Vector pTn-10 MARFBV #5018

This vector (SEQ ID NO:5) is a modification of p5012 (SEQ ID NO:4) described above under section 1.d. The modification includes insertion of the chicken 5' Matrix Attachment Region (MAR) on both the 5' and 3' ends of the multiple cloning site. To accomplish this, the 1.7 kb MAR element was isolated from chicken genomic DNA and amplified by PCR. PCR product was electrophoresed on a 1% agarose gel, stained with ethidium bromide, and visualized on an ultraviolet transilluminator. DNA bands corresponding to the expected size were excised from the gel and purified from the agarose using a Zymo Clean Gel Recovery Kit (Zymo Research, Orange, Calif.).

Purified MAR DNA was digested with restriction enzymes NotI, XhoI, PspOMI, and MluI (New England Biolabs, Beverly, Mass.) according to the manufacturer's protocol. Digested DNA was purified from agarose using a Zymo DNA Clean and Concentrator kit (Zymo Research, Orange Calif.). To insert the 5' MAR element into the MCS of p5012, the purified MAR DNA and p5012 were digested with Not I and Xho I, purified as described above, and ligated using Stratagene's T4 Ligase Kit (La Jolla, Calif.) according to the manufacturer's protocol. To insert the 3' MAR element into the MCS of p5012, the purified MAR DNA and p5012 were digested with PspOMI and MluI, purified, and ligated as described above. Ligated product was transformed into E. coli Top10 cells (Invitrogen Life Technologies, Carlsbad, Calif.) using chemical transformation according to the manufacturer's protocol. Transformed cells were incubated in 1 ml of SOC (GIBCO BRL, CAT#15544-042) for 1 hour at 37° C. and then spread onto LB agar plates supplemented with 100 μg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in a minimum of 250 ml of LB/amp broth, and plasmid DNA was harvested using a Qiagen Maxi-Prep Kit according to the manufacturer's protocol (Qiagen, Inc., Chatsworth, Calif.). Column purified DNA was used as a sequencing template to verify that the changes made in the vector were the desired changes and that no further changes or mutations occurred. All sequencing was performed using a Beckman Coulter CEQ 8000 Genetic Analysis System. Once a clone was identified that contained both MAR elements, the DNA was isolated and used for cloning in specific genes of interest.

All plasmid DNA was isolated by standard procedures. Briefly, E. coli bacteria containing the plasmid of interest were grown in 500 mL of LB broth (supplemented with an appropriate antibiotic) at 37° C. in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 μL of PCR-grade water and stored at −20° C. until needed.

f. Preparation of Transposon-Based Vector TnLysRep #5020

The vector (SEQ ID NO:6) included the chicken lysozyme replicator (LysRep or LR2) insulator elements to prevent gene silencing. Each LysRep element was ligated 3' to the insertion sequences (IS) of the vector. To accomplish this ligation, a 930 bp fragment of the chicken LysRep element (GenBank # NW 060235) was amplified using PCR conditions known to one skilled in the art. Amplified PCR product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.).

Purified LysRep DNA was sequentially digested with restriction enzymes Not I and Xho I (5' end) and Mlu I and Apa I (3' end) (New England Biolabs, Beverly, Mass.) according to the manufacturer's protocol. Digested DNA was purified from restriction enzymes using a Zymo DNA Clean and Concentrator kit (Zymo Research). To insert the LysRep elements between the IS left and the MCS in pTnX-MCS (SEQ ID NO:2), the purified LysRep DNA and pTnX-MCS were digested with Not I and Xho I, purified as described above, and ligated using a Stratagene T4 Ligase Kit (Stratagene, Inc. La Jolla, Calif.) according to the manufacturer's protocol. Ligated product was transformed into E. coli Top10 competent cells (Invitrogen Life Technologies, Carlsbad, Calif.) using chemical transformation according to Invitrogen's protocol. Transformed bacteria were incubated in 1 ml of SOC (GIBCO BRL, CAT#15544-042) medium for 1 hour at 37° C. before being spread to LB media (broth or agar) plates supplemented with 100 µg/ml ampicillin (LB/amp plates). These plates were incubated overnight at 37° C., and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained the 5' LysRep DNA, the vector was digested with Mlu I and Apa I as was the purified LysRep DNA. The same procedures described above were used to ligate the LysRep DNA into the backbone and verify that it was correct. Once a clone was identified that contained both LysRep elements, the DNA was isolated for use in cloning in specific genes of interest.

All plasmid DNA was isolated by standard procedures. Briefly, E. coli containing the plasmid were grown in 500 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

g. Preparation of Transposon-Based Vector TnPuro #5019 (p5019)

This vector (SEQ ID NO:7) is a modification of p5012 (SEQ ID NO:4) described above in section 1.d. The modification includes insertion of the puromycin gene in the multiple cloning site adjacent to one of the HS4 insulator elements. To accomplish this ligation, the 602 bp puromycin gene was isolated from the vector pMOD Puro (Invivogen, Inc.) using PCR conditions known to one skilled in the art. Amplified PCR product was electrophoresed on a 1% agarose gel, stained with ethidium bromide, and visualized on a U.V. transilluminator. A band corresponding to the expected size was excised from the gel and purified from the agarose using a Zymo Clean Gel Recovery Kit (Zymo Research, Orange, Calif.).

Purified Puro DNA was digested with restriction enzyme Kas I (New England Biolabs, Beverly, Mass.) according to the manufacturer's protocol. Digested DNA was purified from restriction enzymes using a Zymo DNA Clean and Concentrator kit (Zymo Research). To insert the Puro gene into the MCS of p5012, the purified Puro DNA and p5012 were digested with Kas I, purified as described above, and ligated using a Stratagene T4 Ligase Kit (Stratagene, Inc. La Jolla, Calif.) according to the manufacturer's protocol. Ligated product was transformed into E. coli Top10 competent cells (Invitrogen Life Technologies, Carlsbad, Calif.) using chemical transformation according to Invitrogen's protocol. Transformed bacteria were incubated in 1 ml of SOC (GIBCO BRL, CAT#15544-042) medium for 1 hour at 37° C. before being spread to LB (broth or agar) plates supplemented with 100 µg/ml ampicillin (LB/amp plates). These plates were incubated overnight at 37° C. and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained both Puro gene, the DNA was isolated for use in cloning in specific genes of interest.

All plasmid DNA was isolated by standard procedures. Briefly, E. coli containing the plasmid were grown in 500 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

h. Preparation of Transposon-Based Vector pTn-10 Puro-MAR #5021 (p5021)

This vector (SEQ ID NO:8) is a modification of p5018 (SEQ ID NO:5) described above in section 1.e. The modification includes insertion of the puromycin (puro) gene into the multiple cloning site adjacent to one of the MAR insulator elements. To accomplish this, the 602 bp puromycin gene was amplified by PCR from the vector pMOD Puro (Invitrogen Life Technologies, Carlsbad, Calif.). Amplified PCR product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.).

Purified DNA from the puromycin gene was digested with the restriction enzymes BsiWI and MluI (New England Biolabs, Beverly, Mass.) according to the manufacturer's protocol. Digested DNA was purified from agarose using a Zymo DNA Clean and Concentrator kit (Zymo Research). To insert the puro gene into the MCS of p5018, puro and p5018 were digested with BsiWI and MluI, purified as described above, and ligated using Stratagene's T4 Ligase Kit (La Jolla, Calif.) according to the manufacturer's protocol. Ligated product was transformed into E. coli Top10 cells (Invitrogen Life Technologies, Carlsbad, Calif.) using chemical transformation according to the manufacturer's protocol. Transformed cells were incubated in 1 ml of SOC (GIBCO BRL, CAT#15544-042) for 1 hour at 37° C. then spread onto LB agar plates supplemented with 100 µg/ml ampicillin (LB/amp plates). These plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in a minimum of 250 ml of LB/amp broth. The plasmid DNA was harvested using a Qiagen Maxi-Prep Kit according to the manufacturer's protocol (Qiagen, Inc., Chatsworth, Calif.). The DNA was used as a sequencing template to verify that the changes made in the vector were desired changes and that no further changes or mutations occurred. All sequencing was performed using Beckman Coulter's CEQ 8000 Genetic Analysis System. Once a clone was identified that contained the puro gene, the DNA was isolated and used for cloning in specific genes of interest.

All plasmid DNA was isolated by standard procedures. Briefly, *E. coli* containing the plasmid of interest was grown in 500 ml of LB broth (supplemented with an appropriate antibiotic) at 37° C. overnight in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

i. Preparation of Transposon-Based Vector TnGenMAR #5022 (p5022)

This vector (SEQ ID NO:9) is a modification of p5021 (SEQ ID NO:8) described above under section 1.h. The modification includes insertion of the gentamycin gene in the multiple cloning site adjacent to one of the MAR insulator elements. To accomplish this ligation, the 1251 by gentamycin gene was isolated from the vector pS65T-C1(ClonTech Laboratories, using PCR conditions known to one skilled in the art. Amplified PCR product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.).

Purified gentamycin DNA was digested with restriction enzyme BsiW I and Mlu I (New England Biolabs, Beverly, Mass.) according to the manufacturer's protocol. Digested DNA was purified from restriction enzymes using a Zymo DNA Clean and Concentrator kit (Zymo Research). To insert the gentamycin gene into the MCS of p5018, the purified gentamycin DNA and p5018 were digested with BsiW I and Mlu I, purified as described above, and ligated using a Stratagene T4 Ligase Kit (Stratagene, Inc. La Jolla, Calif.) according to the manufacturer's protocol. Ligated product was transformed into *E. coli* Top10 competent cells (Invitrogen Life Technologies, Carlsbad, Calif.) using chemical transformation according to Invitrogen's protocol. Transformed bacteria were incubated in 1 ml of SOC (GIBCO BRL, CAT#15544-042) medium for 1 hour at 37° C. before being spread to LB (broth or agar) plates supplemented with 100 µg/ml ampicillin (LB/amp plates). These plates were incubated overnight at 37° C., and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify that the changes made in the vector were the desired changes and that no further changes or mutations occurred. All sequencing was done on a Beckman Coulter CEQ 8000 Genetic Analysis System. Once a clone was identified that contained both Puro gene, the DNA was isolated for use in cloning in specific genes of interest.

All plasmid DNA was isolated by standard procedures. Briefly, *E. coli* containing the plasmid were grown in 500 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

j. Preparation of Low Expression CMV Tn PuroMAR Flanked Backbone #5024 (p5024)

This vector (SEQ ID NO:10) is a modification of p5018 (SEQ ID NO:5), which includes the deletion of the CMV Enhancer region of the transposase cassette. The CMV enhancer was removed from p5018 by digesting the backbone with MscI and Afel restriction enzymes (New England Biolabs, Beverly, Mass.). The digested product was electrophoresed, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size of the backbone without the enhancer region was excised from the gel and purified from the agarose using a Zymo Clean Gel Recovery Kit (Zymo Research, Orange, Calif.).

Backbone DNA from above was re-circularized using an Epicentre Fast Ligase Kit (Epicentre Biotechnologies, Madison, Wis.) according to the manufacturer's protocol. The ligation was transformed into *E. coli* Top10 cells (Invitrogen Life Technologies, Carlsbad, Calif.) using chemical transformation according to the manufacturer's protocol. Transformed cells were incubated in 250 ml of SOC (GIBCO BRL, CAT#15544-042) for 1 hour at 37° C. then spread onto LB agar plates supplemented with 100 µg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in 5 ml of LB/amp broth. Plasmid DNA was harvested using Fermentas' Gene Jet Plasmid Miniprep Kit according to the manufacturer's protocol (Glen Burnie, Md.). The DNA was then used as a sequencing template to verify that any changes made in the vector were desired changes and that no further changes or mutations occurred. All sequencing was performed using Beckman Coulter's CEQ 8000 Genetic Analysis System. Once a clone was identified containing the replacement promoter fragment, the DNA was isolated and used for cloning in specific genes of interest.

All plasmid DNA was isolated by standard procedures. Briefly, *E. coli* bacteria containing the plasmid of interest were grown in a minimum of 500 ml of LB broth (supplemented with an appropriate antibiotic) at 37° C. overnight in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

k. Preparation of Low Expression CMV Tn PuroMAR Flanked Backbone #5025 (p5025)

This vector (SEQ ID NO:11) is a modification of p5021 (SEQ ID NO:8), which includes the deletion of the CMV Enhancer of on the transposase cassette. The CMV enhancer was removed from p5021 by digesting the backbone with MscI and AfeI restriction enzymes (New England Biolabs, Beverly, Mass.). The digested product was electrophoresed, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size of the backbone without the enhancer region was excised from the gel and purified from the agarose using a Zymo Clean Gel Recovery Kit (Zymo Research, Orange, Calif.).

Backbone DNA from above was re-circularized using an Epicentre Fast Ligase Kit (Epicentre Biotechnologies, Madison, Wis.) according to the manufacturer's protocol. The ligation was transformed into E. coli Top10 cells (Invitrogen Life Technologies, Carlsbad, Calif.) using chemical transformation according to the manufacturer's protocol. Transformed cells were incubated in 250 ml of SOC (GIBCO BRL, CAT#15544-042) for 1 hour at 37° C. then spread onto LB (Luria-Bertani) agar plates supplemented with 100 µg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in 5 ml of LB/amp broth. Plasmid DNA was harvested using Fermentas' Gene Jet Plasmid Miniprep Kit according to the manufacturer's protocol (Glen Burnie, Md.). The DNA was then used as a sequencing template to verify that any changes made in the vector were desired changes and that no further changes or mutations occurred. All sequencing was performed using Beckman Coulter's CEQ 8000 Genetic Analysis System. Once a clone was identified containing the replacement promoter fragment, the DNA was isolated and used for cloning in specific genes of interest.

All plasmid DNA was isolated by standard procedures. Briefly, E. coli bacteria containing the plasmid of interest were grown in a minimum of 500 ml of LB broth (supplemented with an appropriate antibiotic) at 37° C. overnight in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

l. Preparation of Low Expression SV40 Promoter Tn PuroMAR Flanked Backbone #5026 (p5026)

This vector (SEQ ID NO:12) is a modification of p5018 (SEQ ID NO:5), which includes the replacement of the CMV Enhanced promoter of the transposase cassette, with the SV40 promoter from pS65T-C1 (Clontech, Mountainview, Calif.). The CMV enhanced promoter was removed from p5018 by digesting the backbone with MscI and AfeI restriction enzymes (New England Biolabs, Beverly, Mass.). The digested product was electrophoresed, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size was excised from the gel and purified from the agarose using a Zymo Clean Gel Recovery Kit (Zymo Research, Orange, Calif.). The SV40 promoter fragment was amplified to add the 5' and 3' cut sites, MscI and AscI, respectively. The PCR product was then cloned into pTopo Blunt II backbone (Invitrogen Life Technologies, Carlsbad, Calif.). Sequence verified DNA was then digested out of the pTopo Blunt II backbone (Invitrogen Life Technologies, Carlsbad, Calif.), with MscI and AfeI restriction enzymes (New England Biolabs, Beverly, Mass.). The digested product was electrophoresed, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size was excised from the gel and purified from the agarose using a Zymo Clean Gel Recovery Kit (Zymo Research, Orange, Calif.).

Purified digestion product was ligated into the excised backbone DNA using Epicentre's Fast Ligase Kit (Madison, Wis.) according to the manufacturer's protocol. The ligation product was transformed into E. coli Top10 cells (Invitrogen Life Technologies, Carlsbad, Calif.) using chemical transformation according to the manufacturer's protocol. Transformed cells were incubated in 250 ml of SOC (GIBCO BRL, CAT#15544-042) for 1 hour at 37° C. before then spread onto LB agar plates supplemented with 100 µg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in 5 ml of LB/amp broth. The plasmid DNA was harvested using a Fermentas' Gene Jet Plasmid Miniprep Kit according to the manufacturer's protocol (Glen Burnie, Md.). The DNA was then used as sequencing template to verify that any changes made in the vector were desired changes and that no further changes or mutations occurred. All sequencing was performed using Beckman Coulter's CEQ 8000 Genetic Analysis System. Once a clone was identified that contained the replacement promoter fragment, the DNA was isolated for use in cloning in specific genes of interest.

All plasmid DNA was isolated by standard procedures. Briefly, E. coli bacteria containing the plasmid of interest were grown in a minimum of 500 mL of LB broth (supplemented with an appropriate antibiotic) at 37° C. overnight in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

m. Preparation of Low Expression SV40 Promoter Tn PuroMAR Flanked Backbone #5027 (p5027)

This vector (SEQ ID NO:13) is a modification of p5021 (SEQ ID NO:8), which includes the replacement of the CMV Enhanced promoter of the transposase cassette, with the SV40 promoter from pS65T-C1 (Clontech, Mountainview, Calif.). The CMV enhanced promoter was removed from p5021 by digesting the backbone with MscI and AfeI restriction enzymes (New England Biolabs, Beverly, Mass.). The digested product was electrophoresed, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size was excised from the gel and purified from the agarose using a Zymo Clean Gel Recovery Kit (Zymo Research, Orange, Calif.). The SV40 promoter fragment was amplified to add the 5' and 3' cut sites, MscI and AscI, respectively. The PCR product was then cloned into pTopo Blunt II backbone (Invitrogen Life Technologies, Carlsbad, Calif.). Sequence verified DNA was then digested out of the pTopo Blunt II backbone (Invitrogen Life Technologies, Carlsbad, Calif.), with MscI and AfeI restriction enzymes (New England Biolabs, Beverly, Mass.). The digested product was electrophoresed, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size was excised from the gel and purified from the agarose using a Zymo Clean Gel Recovery Kit (Zymo Research, Orange, Calif.).

Purified digestion product was ligated into the excised backbone DNA using Epicentre's Fast Ligase Kit (Madison, Wis.) according to the manufacturer's protocol. The ligation product was transformed into E. coli Top10 cells (Invitrogen Life Technologies, Carlsbad, Calif.) using chemical transformation according to the manufacturer's protocol. Transformed cells were incubated in 250 µl of SOC (GIBCO BRL, CAT#15544-042) for 1 hour at 37° C. before being spread onto LB agar plates supplemented with 100 µg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in 5 ml of LB/amp broth. The plasmid DNA was harvested using a Fermentas' Gene Jet Plasmid Miniprep Kit according to the manufacturer's protocol (Glen Burnie, Md.). The DNA was then used as sequencing template to verify that any changes made in the vector were desired changes and that no further changes or mutations occurred. All sequencing was performed using Beckman Coulter's CEQ 8000 Genetic Analysis System. Once a clone was identified that contained the replacement promoter fragment, the DNA was isolated for use in cloning in specific genes of interest.

All plasmid DNA was isolated by standard procedures. Briefly, E. coli bacteria containing the plasmid of interest were grown in a minimum of 500 mL of LB broth (supplemented with an appropriate antibiotic) at 37° C. overnight in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

2. Promoters

A second embodiment of this invention are hybrid promoters that consist of elements from the constitutive CMV promoter and the estrogen inducible ovalbumin promoter. The goal of designing these promoters was to couple the high rate of expression associated with the CMV promoter with the estrogen inducible function of the ovalbumin promoter. To accomplish this goal, two hybrid promoters, designated versions 1 and 2 (SEQ ID NOs:14 and 15, respectively)(FIG. 1), were designed, built, and tested in cell culture using a gene other than a GH gene. Both versions 1 and 2 provided high rates of expression.

a. Version 1 CMV/Oval promoter 1=ChOvp/CMVenh/CMVp

Hybrid promoter version 1 (SEQ ID NO:14) was constructed by ligating the chicken ovalbumin promoter regulatory elements to the 5' end of the CMV enhancer and promoter. A schematic is shown in FIG. 1A.

Hybrid promoter version 1 was made by PCR amplifying nucleotides 1090 to 1929 of the ovalbumin promoter (GenBank # J00895) from the chicken genome and cloning this DNA fragment into the pTopo vector (Invitrogen, Carlsbad, Calif.). Likewise, nucleotides 245-918 of the CMV promoter and enhancer were removed from the pgWiz vector (ClonTech, Mountain View, Calif.) and cloned into the pTopo vector. By cloning each fragment into the multiple cloning site of the pTopo vector, an array of restriction enzyme sites were available on each end of the DNA fragments which greatly facilitated cloning without PCR amplification. Each fragment was sequenced to verify it was the correct DNA sequence. Once sequence verified, the pTopo clone containing the ovalbumin promoter fragment was digested with Xho I and EcoR I, and the product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.). The pTopo clone containing the CMV promoter was treated in the same manner to open up the plasmid 5' to the CMV promoter; these restriction enzymes also allowed directional cloning of the ovalbumin promoter fragment upstream of CMV.

All plasmid DNA was isolated by standard procedures. Briefly, E. coli containing the plasmid were grown in 500 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

b. Version 2 CMV/Oval promoter=ChSDRE/CMVenh/ChNRE/CMVp

Hybrid promoter version 2 (SEQ ID NO:15) consisted of the steroid dependent response element (SDRE) ligated 5' to the CMV enhancer (enh) and the CMV enhancer and promoter separated by the chicken ovalbumin negative response element (NRE).

A schematic is shown in FIG. 1B. Hybrid promoter version 2 was made by PCR amplifying the SDRE, nucleotides 1100 to 1389, and nucleotides 1640 to 1909 of the negative response element (NRE) of the ovalbumin promoter (GenBank # J00895) from the chicken genome and cloning each DNA fragment into the pTopo vector. Likewise, nucleotides 245-843 of the CMV enhancer and nucleotides 844-915 of the CMV promoter were removed from the pgWiz vector and each cloned into the pTopo vector. By cloning each piece into the multiple cloning site of the pTopo vector, an array of restriction enzyme sites were available on each end of the DNA fragments which greatly facilitated cloning without PCR amplification.

Each fragment was sequenced to verify it was the correct DNA sequence. Once sequence verified, the pTopo clone containing the ovalbumin SDRE fragment was digested with Xho I and EcoR I to remove the SDRE, and the product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.). The pTopo clone containing the CMV enhancer was treated in the same manner to open up the plasmid 5' to the CMV enhancer; these restriction enzymes also allowed directional cloning of the ovalbumin SDRE fragment upstream of CMV. The ovalbumin NRE was removed from pTopo using NgoM IV and Kpn I; the same restriction enzymes were used to digest the pTopo clone containing the CMV promoter to allow directional cloning of the NRE.

The DNA fragments were purified as described above. The new pTopo vectors containing the ovalbumin SDRE/CMV enhancer and the NRE/CMV promoter were sequence verified for the correct DNA sequence. Once sequence verified, the pTopo clone containing the ovalbumin SDRE/CMV enhancer fragment was digested with Xho I and NgoM IV to remove the SDRE/CMV Enhancer, and the product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.). The pTopo clone containing the NRE/CMV promoter was treated in the same manner to open up the plasmid 5' to the CMV enhancer. These restriction enzymes also allowed directional cloning of the ovalbumin SDRE fragment upstream of CMV. The resulting promoter hybrid was sequence verified to insure that it was correct. All plasmid DNA was isolated by standard procedures. Briefly, E. coli containing the plasmid were grown in 500 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 500 4, of PCR-grade water and stored at −20° C. until needed.

c. Version 3 Promoter CMV/Oval Promoter=CMVenh/ChOvp/CMVp

Hybrid promoter version 3 is shown at base pairs 4937 to 6465 of SEQ ID NO:19. This promoter consisted of the CMV enhancer and promoter being separated by the regulatory elements of the chicken ovalbumin promoter (OVp). Due to the size of the ovalbumin promoter elements separating the CMV enhancer and promoter, it was expected that protein expression would be decreased with this promoter. This was indeed the case in cell culture.

3. Transposases and Insertion Sequences

In a further embodiment of the present invention, the transposase found in the transposase-based vector is an altered target site (ATS) transposase and the insertion sequences are those recognized by the ATS transposase. However, the transposase located in the transposase-based vectors is not limited to a modified ATS transposase and can be derived from any transposase. Transposases known in the prior art include those found in AC7, Tn5SEQ1, Tn916, Tn951, Tn1721, Tn 2410, Tn1681, Tn1, Tn2, Tn3, Tn4, Tn5, Tn6, Tn9, Tn10, Tn30, Tn101, Tn903, Tn501, Tn1000 (γδ), Tn1681, Tn2901, AC transposons, Mp transposons, Spm transposons, En transposons, Dotted transposons, Mu transposons, Ds transposons, dSpm transposons and I transposons. According to the present invention, these transposases and their regulatory sequences are modified for improved functioning as follows: a) the addition one or more modified Kozak sequences comprising any one of SEQ ID NOs:28 to 37 at the 3' end of the promoter operably-linked to the transposase; b) a change of the codons for the first several amino acids of the transposase, wherein the third base of each codon was changed to an A or a T without changing the corresponding amino acid; c) the addition of one or more stop codons to enhance the termination of transposase synthesis; and/or, d) the addition of an effective polyA sequence operably-linked to the transposase to further enhance expression of the transposase gene.

Although not wanting to be bound by the following statement, it is believed that the modifications of the first several N-terminal codons of the transposase gene increase transcription of the transposase gene, in part, by increasing strand dissociation. It is preferable that between approximately 1 and 20, more preferably 3 and 15, and most preferably between 4 and 12 of the first N-terminal codons of the transposase are modified such that the third base of each codon is changed to an A or a T without changing the encoded amino acid. In one embodiment, the first ten N-terminal codons of the transposase gene are modified in this manner. It is also preferred that the transposase contain mutations that make it less specific for preferred insertion sites and thus increases the rate of transgene insertion as discussed in U.S. Pat. No. 5,719,055.

In some embodiments, the transposon-based vectors are optimized for expression in a particular host by changing the methylation patterns of the vector DNA. For example, prokaryotic methylation may be reduced by using a methylation deficient organism for production of the transposon-based vector. The transposon-based vectors may also be methylated to resemble eukaryotic DNA for expression in a eukaryotic host.

Transposases and insertion sequences from other analogous eukaryotic transposon-based vectors that can also be modified and used are, for example, the Drosophila P element derived vectors disclosed in U.S. Pat. No. 6,291,243; the Drosophila mariner element described in Sherman et al. (1998); or the sleeping beauty transposon. See also Hackett et al. (1999); D. Lampe et al., 1999. Proc. Natl. Acad. Sci. USA, 96:11428-11433; S. Fischer et al., 2001. Proc. Natl. Acad. Sci. USA, 98:6759-6764; L. Zagoraiou et al., 2001. Proc. Natl. Acad. Sci. USA, 98:11474-11478; and D. Berg et al. (Eds.), Mobile DNA, Amer. Soc. Microbiol. (Washington, D.C., 1989). However, it should be noted that bacterial transposon-based elements are preferred, as there is less likelihood that a eukaryotic transposase in the recipient species will recognize prokaryotic insertion sequences bracketing the transgene.

Many transposases recognize different insertion sequences, and therefore, it is to be understood that a transposase-based vector will contain insertion sequences recognized by the particular transposase also found in the transposase-based vector. In a preferred embodiment of the invention, the insertion sequences have been shortened to about 70 base pairs in length as compared to those found in wild-type transposons that typically contain insertion sequences of well over 100 base pairs.

While the examples provided below incorporate a "cut and insert" Tn10 based vector that is destroyed following the insertion event, the present invention also encompasses the use of a "rolling replication" type transposon-based vector. Use of a rolling replication type transposon allows multiple copies of the transposon/transgene to be made from a single transgene construct and the copies inserted. This type of transposon-based system thereby provides for insertion of multiple copies of a transgene into a single genome. A rolling replication type transposon-based vector may be preferred when the promoter operably-linked to gene of interest is endogenous to the host cell and present in a high copy number or highly expressed. However, use of a rolling replication system may require tight control to limit the insertion events to non-lethal levels. Tn1, Tn2, Tn3, Tn4, Tn5, Tn9, Tn21, Tn501, Tn551, Tn951, Tn1721, Tn2410 and Tn2603 are examples of a rolling replication type transposon, although Tn5 could be both a rolling replication and a cut and insert type transposon.

4. Other Promoters and Enhancers

The first promoter operably-linked to the transposase gene and the second promoter operably-linked to the gene of interest can be a constitutive promoter or an inducible promoter. Constitutive promoters include, but are not limited to, immediate early cytomegalovirus (CMV) promoter, herpes simplex virus 1 (HSV1) immediate early promoter, SV40 promoter, lysozyme promoter, early and late CMV promoters, early and late HSV promoters, β-actin promoter, tubulin promoter, Rous-Sarcoma virus (RSV) promoter, and heat-shock protein (HSP) promoter. Inducible promoters include tissue-specific promoters, developmentally-regulated promoters and chemically inducible promoters. Examples of tissue-specific promoters include the glucose-6-phosphatase (G6P) promoter, vitellogenin promoter, ovalbumin promoter, ovomucoid promoter, conalbumin promoter, ovotransferrin promoter, prolactin promoter, kidney uromodulin promoter, and placental lactogen promoter. The G6P promoter sequence may be deduced from a rat G6P gene untranslated upstream region provided in GenBank accession number U57552.1. Examples of developmentally-regulated promoters include the homeobox promoters and several hormone induced promoters. Examples of chemically inducible promoters include reproductive hormone induced promoters and antibiotic inducible promoters such as the tetracycline inducible promoter and the zinc-inducible metallothionine promoter.

Other inducible promoter systems include the Lac operator repressor system inducible by IPTG (isopropyl beta-D-thiogalactoside) (Cronin, A. et al. 2001. Genes and Development, v. 15), ecdysone-based inducible systems (Hoppe, U. C. et al. 2000. Mol. Ther. 1:159-164); estrogen-based inducible systems (Braselmann, S. et al. 1993. Proc. Natl. Acad. Sci. 90:1657-1661); progesterone-based inducible systems using a chimeric regulator, GLVP, which is a hybrid protein consisting of the GAL4 binding domain and the herpes simplex virus transcriptional activation domain, VP16, and a truncated form of the human progesterone receptor that retains the ability to bind ligand and can be turned on by RU486 (Wang, et al. 1994. Proc. Natl. Acad. Sci. 91:8180-8184); CID-based inducible systems using chemical inducers of dimerization (CIDs) to regulate gene expression, such as a system wherein rapamycin induces dimerization of the cellular proteins FKBP12 and FRAP (Belshaw, P. J. et al. 1996. J. Chem. Biol. 3:731-738; Fan, L. et al. 1999. Hum. Gene Ther. 10:2273-2285; Shariat, S. F. et al. 2001. Cancer Res. 61:2562-2571; Spencer, D. M. 1996. Curr. Biol. 6:839-847). Chemical substances that activate the chemically inducible promoters can be administered to the animal containing the transgene of interest via any method known to those of skill in the art.

Other examples of cell-specific and constitutive promoters include but are not limited to smooth-muscle SM22 promoter, including chimeric SM22alpha/telokin promoters (Hoggatt A. M. et al., 2002. Circ Res. 91(12):1151-9); ubiquitin C promoter (Biochim Biophys Acta, 2003. Jan. 3; 1625(1):52-63); Hsf2 promoter; murine COMP (cartilage oligomeric matrix protein) promoter; early B cell-specific mb-1 promoter (Sigvardsson M., et al., 2002. Mol. Cell. Biol. 22(24): 8539-51); prostate specific antigen (PSA) promoter (Yoshimura I. et al., 2002, J. Urol. 168(6):2659-64); exorh promoter and pineal expression-promoting element (Asaoka Y., et al., 2002. Proc. Natl. Acad. Sci. 99(24):15456-61); neural and liver ceramidase gene promoters (Okino N. et al., 2002. Biochem. Biophys. Res. Commun. 299(1):160-6); PSP94 gene promoter/enhancer (Gabril M. Y. et al., 2002. Gene Ther. 9(23):1589-99); promoter of the human FAT/CD36 gene (Kuriki C., et al., 2002. Biol. Pharm. Bull. 25(11): 1476-8); VL30 promoter (Staplin W. R. et al., 2002. Blood Oct. 24, 2002); and, IL-10 promoter (Brenner S., et al., 2002. J. Biol. Chem. Dec. 18, 2002). Additional promoters are shown in Table 1.

Examples of avian promoters include, but are not limited to, promoters controlling expression of egg white proteins, such as ovalbumin, ovotransferrin (conalbumin), ovomucoid, lysozyme, ovomucin, g2 ovoglobulin, g3 ovoglobulin, ovoflavoprotein, ovostatin (ovomacroglobin), cystatin, avidin, thiamine-binding protein, glutamyl aminopeptidase minor glycoprotein 1, minor glycoprotein 2; and promoters controlling expression of egg-yolk proteins, such as vitellogenin, very low-density lipoproteins, low density lipoprotein, cobalamin-binding protein, riboflavin-binding protein, biotin-binding protein (Awade, 1996. Z. Lebensm. Unters. Forsch. 202:1-14). An advantage of using the vitellogenin promoter is that it is active during the egg-laying stage of an animal's life-cycle, which allows for the production of the protein of interest to be temporally connected to the import of the protein of interest into the egg yolk when the protein of interest is equipped with an appropriate targeting sequence. As used herein, the "protein of interest" is GH. In some embodiments, the avian promoter is an oviduct-specific promoter. As used herein, the term "oviduct-specific promoter" includes, but is not limited to, ovalbumin; ovotransferrin (conalbumin); ovomucoid; 01, 02, 03, 04 or 05 avidin; ovomucin; g2 ovoglobulin; g3 ovoglobulin; ovoflavoprotein; and ovostatin (ovomacroglobin) promoters.

When germline transformation occurs via cardiovascular, intraovarian or intratesticular administration, or when hepatocytes are targeted for incorporation of components of a vector through non-germ line administration, liver-specific promoters may be operably-linked to the gene of interest to achieve liver-specific expression of the transgene. Liver-specific promoters of the present invention include, but are not limited to, the following promoters, vitellogenin promoter, G6P promoter, cholesterol-7-alpha-hydroxylase (CYP7A) promoter, phenylalanine hydroxylase (PAH) promoter, protein C gene promoter, insulin-like growth factor I (IGF-I) promoter, bilirubin UDP-glucuronosyltransferase promoter, aldolase B promoter, furin promoter, metallothionine promoter, albumin promoter, and insulin promoter.

Also included in this invention are modified promoters/enhancers wherein elements of a single promoter are duplicated, modified, or otherwise changed. In one embodiment, steroid hormone-binding domains of the ovalbumin promoter are moved from about −3.5 kb to within approximately the first 1000 base pairs of the gene of interest. Modifying an existing promoter with promoter/enhancer elements not found naturally in the promoter, as well as building an entirely synthetic promoter, or drawing promoter/enhancer elements from various genes together on a non-natural backbone, are all encompassed by the current invention.

Accordingly, it is to be understood that the promoters contained within the transposon-based vectors of the present invention may be entire promoter sequences or fragments of promoter sequences. The constitutive and inducible promoters contained within the transposon-based vectors may also be modified by the addition of one or more modified Kozak sequences comprising any one of SEQ ID NOs:40 to 49.

As indicated above, the present invention includes transposon-based vectors containing one or more enhancers. These enhancers may or may not be operably-linked to their native promoter and may be located at any distance from their operably-linked promoter. A promoter operably-linked to an enhancer and a promoter modified to eliminate repressive regulatory effects are referred to herein as an "enhanced promoter." The enhancers contained within the transposon-based vectors may be enhancers found in birds, such as an ovalbumin enhancer, but are not limited to these types of enhancers. In one embodiment, an approximately 675 base pair enhancer element of an ovalbumin promoter is cloned upstream of an ovalbumin promoter with 300 base pairs of spacer DNA separating the enhancer and promoter. In one embodiment, the enhancer used as a part of the present invention comprises base pairs 1-675 of a chicken ovalbumin enhancer from GenBank accession #S82527.1. The polynucleotide sequence of this enhancer is provided in SEQ ID NO:50.

Also included in some of the transposon-based vectors of the present invention are cap sites and fragments of cap sites. In one embodiment, approximately 50 base pairs of a 5' untranslated region wherein the capsite resides are added on the 3' end of an enhanced promoter or promoter. An exemplary 5' untranslated region is provided in SEQ ID NO:51. A putative cap-site residing in this 5' untranslated region preferably comprises the polynucleotide sequence provided in SEQ ID NO:52.

In one embodiment of the present invention, the first promoter operably-linked to the transposase gene is a constitutive promoter and the second promoter operably-linked to the gene of interest is a cell specific promoter. In the second embodiment, use of the first constitutive promoter allows for constitutive activation of the transposase gene and incorporation of the gene of interest into virtually all cell types, including the germline of the recipient animal. Although the gene of interest is incorporated into the germline generally, the gene of interest may only be expressed in a tissue-specific manner to achieve gene therapy. A transposon-based vector having a constitutive promoter operably-linked to the transposase gene can be administered by any route, and in several embodiments, the vector is administered to the cardiovascular system, directly to an ovary, to an artery leading to the ovary or to a lymphatic system or fluid proximal to the ovary. In another embodiment, the transposon-based vector having a constitutive promoter operably-linked to the transposase gene can be administered to vessels supplying the liver, muscle, brain, lung, kidney, heart or any other desired organ, tissue or cellular target. In another embodiment, the transposon-based vector having a constitutive promoter operably-linked to the transposase gene can be administered to cells for culture in vitro.

It should be noted that cell- or tissue-specific expression as described herein does not require a complete absence of expression in cells or tissues other than the preferred cell or tissue. Instead, "cell-specific" or "tissue-specific" expression refers to a majority of the expression of a particular gene of interest in the preferred cell or tissue, respectively.

When incorporation of the gene of interest into the germline is not preferred, the first promoter operably-linked to the transposase gene can be a tissue-specific or cell-specific promoter. For example, transfection of a transposon-based vector containing a transposase gene operably-linked to a liver specific promoter such as the G6P promoter or vitellogenin promoter provides for activation of the transposase gene and incorporation of the gene of interest in the cells of the liver in vivo, or in vitro, but not into the germline and other cells generally. In another example, transfection of a transposon-based vector containing a transposase gene operably-linked to an oviduct specific promoter such as the ovalbumin promoter provides for activation of the transposase gene and incorporation of the gene of interest in the cells of the oviduct in vivo or into oviduct cells in vitro, but not into the germline and other cells generally. In this embodiment, the second promoter operably-linked to the gene of interest can be a constitutive promoter or an inducible promoter. In one embodiment, both the first promoter and the second promoter are an ovalbumin promoter. In embodiments wherein tissue-specific expression or incorporation is desired, it is preferred that the transposon-based vector is administered directly to the tissue of interest, to the cardiovascular system which provides blood supply to the tissue of interest, to an artery leading to the organ or tissue of interest or to fluids surrounding the organ or tissue of interest. In one embodiment, the tissue of interest is the oviduct and administration is achieved by direct injection into the oviduct, into the cardiovascular system, or an artery leading to the oviduct. In another embodiment, the tissue of interest is the liver and administration is achieved by direct injection into the cardiovascular system, the portal vein or hepatic artery. In another embodiment, the tissue of interest is cardiac muscle tissue in the heart and administration is achieved by direct injection into the coronary arteries or left cardiac ventricle. In another embodiment, the tissue of interest is neural tissue and administration is achieved by direct injection into the cardiovascular system, the left cardiac ventricle, a cerebrovascular or spinovascular artery. In yet another embodiment, the target is a solid tumor and the administration is achieved by injection into a vessel supplying the tumor or by injection into the tumor.

Accordingly, cell specific promoters may be used to enhance transcription in selected tissues. In birds, for example, promoters that are found in cells of the fallopian tube, such as ovalbumin, conalbumin, ovomucoid and/or lysozyme, are used in the vectors to ensure transcription of the gene of interest in the epithelial cells and tubular gland cells of the fallopian tube, leading to synthesis of the desired protein encoded by the gene and deposition into the egg white. In liver cells, the G6P promoter may be employed to drive transcription of the gene of interest for protein production. Proteins made in the liver of birds may be delivered to the egg yolk. Proteins made in transfected cells in vitro may be released into cell culture medium.

In order to achieve higher or more efficient expression of the transposase gene, the promoter and other regulatory sequences operably-linked to the transposase gene may be those derived from the host. These host specific regulatory sequences can be tissue specific as described above or can be of a constitutive nature.

TABLE 1

| Reproductive tissue | Promoter | Ref. | Function/comments |
|---|---|---|---|
| testes, spermatogenesis | SPATA4 | 1 | constitutive 30 d after birth in rat |
| placenta, glycoprotein | ERVWE1 | 2 | URE, Upstream Regulatory Element is tissue spec. enhancer |
| breast epithelium and breast cancer | mammaglobin | 6 | specific to breast epithelium and cancer |
| prostate | EPSA | 17 | enhanced prostate-specific antigen promoter |
| testes | ATC | 25 | AlphaT-catenin specific for testes, skeletal, brain cardiomyocytes |
| prostate | PB | 67 | probasin promoter |
| Vision | | | |
| rod/cone | mCAR | 3 | cone photoreceptors and pinealocytes |
| retina | ATH5 | 15 | functions in retinal ganglia and precursors |
| eye, brain | rhodopsin | 27 | |
| kertocytes | keratocan | 42 | specific to the corneal stroma |
| retina | RPE65 | 59 | |

TABLE 1-continued

| Reproductive tissue | Promoter | Ref. | Function/comments |
|---|---|---|---|
| Muscle | | | |
| vascular smooth muscle | TFPI | 13 | Tissue Factor Pathway Inhibitor - low level expression in endothelial and smooth muscle cells of vascular system |
| cardiac specific | MLC2v | 14, 26 | ventricular myosin light chain |
| cardiac | CAR3 | 18 | BMP response element that directs cardiac specific expression |
| skeletal | C5-12 | 22 | high level, muscle spec expression to drive target gene |
| skeletal | AdmDys, AdmCTLA4Ig | 32 | muscle creatine kinase promoter |
| smooth muscle | PDE5A | 41 | chromosome 4q26, phosphodiesterase |
| smooth muscle | AlphaTM | 45 | use intronic splicing elements to restrict expression to smooth muscle vs skeletal |
| skeletal | myostatin | 48 | fiber type-specific expression of myostatin |
| Endocrine/nervous | | | |
| glucocorticoid | GR 1B-1E | 4, 12 | glucocorticoid receptor promoter/all cells |
| neuroblastoma | M2-2 | 8, 36 | M2 muscarinic receptor |
| brain | Abeta | 16 | amyloid beta-protein; 30 bp fragment needed for PC12 and glial cell expression |
| brain | enolase | 21 | neuron-specific; high in hippocampus, intermediate in cortex, low in cerebellum |
| synapses | rapsyn | 29 | clusters acetylcholine receptors at neuromuscular junction |
| neuropeptide precursor | VGF | 39 | express limited to neurons in central and peripheral nervous system and specific endocrine cells in adenohypophysis, adrenal medulla, GI tract and pancreas |
| mammalian nervous system | BMP/RA | 46 | use of methylation to control tissue specificity in neural cells. |
| central and peripheral noradrenergic neurons | Phox2a/Phox2b | 47 | regulation of neuron differentiation |
| brain | BAI1-AP4 | 55 | spec to cerebral cortex and hippocampus |
| Gastrointestinal | | | |
| UDP glucoronsyltransferase | UGT1A7 | 11 | gastric mucosa |
| | UGT1A8 | 11 | small intestine and colon |
| | UGT1A10 | 11 | small intestine and colon |
| colon cancer | PKCbetaII | 20 | Protein kinase C betaII (PKCbetaII); express in colon cancer to selectively kill it. |
| Cancer | | | |
| tumor suppressor 4.1B | 4.1B | 5 | 2 isoforms, 1 spec to brain, 1 in kidney |
| nestin | nestin | 63 | second intron regulates tissue specificity |
| cancer spec promoter | hTRT/hSPA1 | 68 | dual promoter system for cancer specificity |
| Blood/lymph system | | | |
| Thyroid | thyroglobulin | 10 | Thyroid spec. -- express to kill thyroid tumors |
| Thyroid | calcitonin | 10 | medullary thyroid tumors |
| Thyroid | GR 1A | 12 | |
| thyroid | thyroglobulin | 50 | regulation controlled by DREAM transcriptional repressor |
| arterial endothelial cells | ALK1 | 60 | activin receptor-like kinase |
| Nonspecific | | | |
| RNA polymerase II | | 7 | |
| gene silencing | Gnasx1, Nespas | 31 | |
| beta-globin | beta globin | 53 | |
| Cardiac | M2-1 | 8 | M2 muscarinic receptor |
| Lung | hBD-2 | 19 | IL-17 induced transcription in airway epithelium |
| pulmonary surfactant protein | SP-C | 62 | Alveolar type II cells |
| ciliated cell-specific prom | FOZJ1 | 70 | use in ciliated epithelial cells for CF treatment |
| surfactant protein expression | SPA-D | 73 | Possible treatment in premature babies |
| Clara cell secretory protein | CCSP | 75 | |
| Dental | | | |
| teeth/bone | DSPP | 28 | extracellular matrix protein dentin sialophosphoprotein |
| Adipose | | | |
| adipogenesis | EPAS1 | 33 | endothelial PAS domain -- role in adipocyte differentiation |

TABLE 1-continued

| Reproductive tissue | Promoter | Ref. | Function/comments |
|---|---|---|---|
| Epidermal | | | |
| differentiated epidermis | involucrin | 38 | |
| desmosomal protein | CDSN | 58 | stratum granulosum and stratum corneum of epidermis |
| Liver | | | |
| liver spec albumin | Albumin | 49 | |
| serum alpha-fetoprotein | AFP | 56 | liver spec regulation |

References
1. Biol Pharm Bull. 2004 Nov; 27(11): 1867-70
2. J Virol. 2004 Nov; 78(22): 12157-68
3. Invest Ophthalmol Vis Sci. 2004 Nov; 45(11): 3877-84
4. Biochim Biophys Acta. 2004 Oct 21; 1680(2): 114-28
5. Biochim Biophys Acta. 2004 Oct 21; 1680(2): 71-82
6. Curr Cancer Drug Targets. 2004 Sep; 4(6): 531-42
7. Biotechnol Bioeng. 2004 Nov 20; 88(4): 417-25
8. J Neurochem. 2004 Oct; 91(1): 88-98
10. Curr Drug Targets Immune Endocr Metabol Disord. 2004 Sep; 4(3): 235-44
11. Toxicol Appl Pharmacol. 2004 Sep 15; 199(3): 354-63
12. J Immunol. 2004 Sep 15; 173(6): 3816-24
13. Thromb Haemost. 2004 Sep; 92(3): 495-502
14. Acad Radiol. 2004 Sep; 11(9): 1022-8
15. Development. 2004 Sep; 131(18): 4447-54
16. J Neurochem. 2004 Sep; 90(6): 1432-44
17. Mol Ther. 2004 Sep; 10(3): 545-52
18. Development. 2004 Oct; 131(19): 4709-23. Epub 2004 Aug 25
19. J Immunol. 2004 Sep 1; 173(5): 3482-91
20. J Biol Chem. 2004 Oct 29; 279(44): 45556-63. Epub 2004 Aug 20
21. J Biol Chem. 2004 Oct 22; 279(43): 44795-801. Epub 2004 Aug 20
22. Hum Gene Ther. 2004 Aug; 15(8): 783-92
25. Nucleic Acids Res. 2004 Aug 09; 32(14): 4155-65. Print 2004
26. Mol Imaging. 2004 Apr; 3(2): 69-75
27. J Gene Med. 2004 Aug; 6(8): 906-12
28. J Biol Chem. 2004 Oct 1; 279(40): 42182-91. Epub 2004 Jul 28
29. Mol Cell Biol. 2004 Aug; 24(16): 7188-96
31. Nat Genet. 2004 Aug; 36(8): 894-9. Epub 2004 Jul 25
32. Gene Ther. 2004 Oct; 11(19): 1453-61
33. J Biol Chem. 2004 Sep 24; 279(39): 40946-53. Epub 2004 Jul 15
36. Brain Res Mol Brain Res. 2004 Jul 26; 126(2): 173-80
38. J Invest Dermatol. 2004 Aug; 123(2): 313-8
39. Cell Mol Neurobiol. 2004 Aug; 24(4): 517-33
41. Int J Impot Res. 2004 Jun; 16 Suppl 1: S8-S10
42. Invest Ophthalmol Vis Sci. 2004 Jul; 45(7): 2194-200
45. J Biol Chem. 2004 Aug 27; 279(35): 36660-9. Epub 2004 Jun 11
46. Brain Res Mol Brain Res. 2004 Jun 18; 125(1-2): 47-59
47. Brain Res Mol Brain Res. 2004 Jun 18; 125(1-2): 29-39
48. Am J Physiol Cell Physiol. 2004 Oct; 287(4): C1031-40. Epub 2004 Jun 09
49. Xi Bao Yu Fen Zi Mian Yi Xue Za Zhi. 2003 Nov; 19(6): 601-3
50. J Biol Chem. 2004 Aug 6; 279(32): 33114-22. Epub 2004 Jun 04
53. Brief Funct Genomic Proteomic. 2004 Feb; 2(4): 344-54
55. FEBS Lett. 2004 May 21; 566(1-3): 87-94
56. Biochem Biophys Res Commun. 2004 Jun 4; 318(3): 773-85
58. J Invest Dermatol. 2004 Mar; 122(3): 730-8
59. Mol Vis. 2004 Mar 26; 10: 208-14
60. Circ Res. 2004 Apr 30; 94(8): e72-7. Epub 2004 Apr 01
62. Am J Physiol Lung Cell Mol Physiol. 2004 Dec 3; [Epub ahead of print]
63. Lab Invest. 2004 Dec; 84(12): 1581-92
67. Prostate. 2004 Jun 1; 59(4): 370-82
68. Cancer Res. 2004 Jan 1; 64(1): 363-9
70. Mol Ther. 2003 Oct; 8(4): 637-45
73. Front Biosci. 2003 May 01; 8: d751-64
75. Am J Respir Cell Mol Biol. 2002 Aug; 27(2): 186-93

4. Vectors for hGH Production

The vectors of the present invention employ some of the vector components (backbone vectors and promoters) described in the previous section and also include the multiple cloning site (MCS) comprising the gene of interest. In one embodiment, the gene of interest encodes GH. In one embodiment the gene of interest encodes human (h)GH. The vectors SEQ ID NO:17 through 39 are all provided in the Appendix and all contain a gene of interest encoding hGH.

B. Methods of Transfecting Cells

1. Transfection of LMH2A and LMH Cells In Vitro
DNA

GH expression vector DNA (e.g., any one of SEQ ID NOs:17-39) DNA was prepared in either methylating or non-methylating bacteria, and was endotoxin-free. Agarose gels showed a single plasmid of the appropriate size. DNA was resuspended in molecular biology grade, sterile water at a concentration of at least 0.5 μg/μl. The concentration was verified by spectrophotometry, and the 260/280 ratio was 1.8 or greater. A stock of each DNA sample, diluted to 0.5 ug/ul in sterile, molecular biology grade water, was prepared in the cell culture lab, and this stock used for all transfections. When not in use, the DNA stocks were kept frozen at −30° C. in small aliquots to avoid repeated freezing and thawing.

Transfection

The transfection reagent used for LMH2A or LMH cells was FuGENE 6 (Roche Applied Science). This reagent was used at a 1:6 ratio (ug of DNA:ul of transfection reagent) for all transfections in LMH2A or LMH cells. The chart below shows the amount of DNA and FuGENE 6 used for typical cell culture formats (T25 and T75 tissue culture flasks). If it is necessary to perform transfections in other formats, the amounts of serum free medium (SFM), FuGENE 6 and DNA are scaled appropriately based on the surface area of the flask or well used. The diluent (SFM) is any serum-free cell culture media appropriate for the cells and it did not contain any antibiotics or fungicides.

TABLE 2

DNA:FuGENE = 1:6
[DNA] = 0.5 µg/µl

|  | T25 | T75 |
|---|---|---|
| SFM | 250 µl | 800 µl |
| FuGENE 6 | 12 µl | 48 µl |
| DNA | 4 µl | 16 µl |

1. Cells used for transfection were split 24-48 hours prior to the experiment, so that they were actively growing and 50-80% confluent at the time of transfection.
2. FuGENE was warmed to room temperature before use. Because FuGENE is sensitive to prolonged exposure to air, the vial was kept tightly closed when not in use. The vial of FuGENE was returned to the refrigerator as soon as possible.
3. The required amount of FuGENE was pipetted into the SFM in a sterile microcentrifuge tube. The fluid was mixed gently but thoroughly, by tapping or flicking the tube, and incubated for 5 minutes at room temperature.
4. The required amount of DNA was added to the diluted FuGENE and mixed by vortexing for one second.
5. The mixture was incubated at room temperature for 1 hour.
6. During the incubation period, media on cells was replaced with fresh growth media. This media optionally contained serum, if needed, but did not contain antibiotics or fungicides unless absolutely required, as this can reduce the transfection efficiency.
7. The entire volume of the transfection complex was added to the cells. The flask was rocked to mix thoroughly.
8. The flasks were incubated at 37° C. and 5% $CO_2$.
9. Cells were fed and samples obtained as required. After the first 24 hours, cells were optionally fed with media containing antibiotics and/or fungicides, if desired.

2. Transfection of Other Cells

The same methods described above for LMH and LMH2A cells are used for transfection of chicken tubular gland cells or other cell types such as Chinese hamster ovary (CHO) cells, CHO-K1 cells, chicken embryonic fibroblasts, HeLa cells, Vero cells, FAO (liver cells), human 3T3 cells, A20 cells, EL4 cells, HepG2 cells, J744A cells, Jurkat cells, P388D1 cells, RC-4B/c cells, SK—N—SH cells, Sp2/mL-6 cells, SW480 cells, 3T6 Swiss cells, human myeloma cells, and human ARPT-19 cells.

C. Production and Purification of the Recombinant Fusion Protein, 3xFlag-hGH, Produced by the Transfected Cells 1. Media Preparation.

Media containing recombinant 3xFlag-hGH produced by transfected cells was harvested and immediately frozen. Later the medium was thawed, filtered through a 0.45 micron cellulose acetate bottle-top filter to ensure that all particulate was removed prior to being loaded on the column.

2. Affinity Purification

The medium containing recombinant 3xFlag-hGH produced by transfected cells was subjected to affinity purification using an Anti-Flag M2 Affinity Gel (Sigma, product code A2220) loaded onto a Poly-Prep Chromatography Columns (BioRad, catalog 731-1550). A slurry of anti-flag M2 gel was applied to Poly-Prep Chromatography Column and the column was equilibrated at 1 ml/min with wash buffer (Tris Buffered Saline (TBS)) for 30 column volumes. After equilibration was complete, the prepared medium containing 3xFlag-hGH from cultured and transfected cells was applied to the column.

The media sample passed through the column, and the column was washed for 10 column volumes with TBS. Next, 8 column volumes elution buffer (100 mM Tris, 0.5M NaCl, pH 2.85) were run through the column, followed by 4 column volumes of TBS and the eluent was collected. The eluent was transferred to an Amicon Ultra-15 (that was pre-washed with TBS) and centrifuged at 3,500×g until the sample was concentrated to the desired volume.

3. Size Exclusion Chromatography

The concentrated eluent from the affinity purification procedure was then subjected to size exclusion chromatography as a final step in the purification procedure. First, a superdex 200 10/300 GL column (GE Healthcare) was equilibrated with TBS. Multiple size exclusion runs were done in which a sample volume of 250 µl for each run was passed over the column. Fractions containing 3xFlag-hGH from each run were then pooled, transferred to an Amicon Ultra-15, and concentrated to the desired final volume.

The purification procedure was evaluated at various stages using a sandwich ELISA assay. SDS-PAGE analysis with subsequent Coomassie blue staining was done to indicate both molecular weight and purity of the purified 3xFlag-hGH.

4. Measurement of Purified 3xFlag-hGH

The purified 3xFlag-hGH was quantitated using: densitometry on a Coomassie stained SDS-PAGE gel using known concentrations of hGH standard; densitometry on Western Blots using known concentrations of hGH standard and/or 3xFlag-alkaline phosphatase; and indirect ELISA using known concentrations of hGH standard.

5. Enterokinase Digestion of 3xFlag-hGH

In order to produce the mature hGH from the purified recombinant 3xFlag-hGH, the amino-terminal 3xFlag epitope was removed by enterokinase digestion. Recombinant enterokinase (Novagen) was added to the purified 3xFlag-hGH at a ratio of 1.0 Unit of enterokinase to 50 µg of 3xFlag-hGH. The reaction was incubated at room temperature for 16 hours with gentle agitation. Removal of the 3xFlag epitope was evidenced by a band shift on a Coomassie stained SDS-PAGE gel in which the enterokinase digested 3xFlag-hGH migrated at a lower molecular weight relative to the undigested 3xFlag-hGH. Additionally, Western blot analysis indicated that the 3xFlag epitope was no longer present on the enterokinase digested 3xFlag-hGH when the blot was probed against anti-flag immunoglobulins.

D. 3xFlag-hGH Detection 1. 3xFlag-h GH Measurement with ELISA

3xFlag-hGH was measured using the following sandwich ELISA protocol:
1. Diluted monoclonal anti-hGH (Biodesign International, Cat. # E45902M) 1:1000 in 2×-carbonate, pH 9.6 such that the final working dilution concentration is 3.13 µg/mL.
2. Added 100 uL of the diluted antibody into to the appropriate wells of the ELISA plate.
3. Allowed 96-well plate to coat overnight at 4° C. or for 1 hr at 37° C.
4. Washed the ELISA plate five times with wash buffer (1×TBS/0.05% TWEEN).
5. Transferred 200 µL of blocking buffer (1.5% BSA/1×TBS/0.05% TWEEN) to the appropriate wells of the ELISA plate and allowed 96-well plate to block overnight @ 4° C. or for 45 minutes at room temperature.
6. Diluted the purified fusion 3xFlag-hGH standard in negative control media (5% FCS/Waymouth, Gibco) such that the final working dilution concentration was 16 ng/mL.
7. Dilute test samples in negative control media (5% FCS/Waymouth, Gibco).
8. Removed the blocking buffer by manually "flicking" the ELISA plate into the sink.
9. Added the diluted samples and fusion protein standards into 96-well plate and incubated the ELISA plate at room temperature for 1 hour.
10. Diluted fresh Anti FLAG M2 Alkaline Phosphatase Antibody 1:8,000 (Sigma, Cat. # A9469) such that the final working dilution concentration was 125 ng/mL.
11. Added 100 µL of the diluted antibody into to the appropriate wells of the ELISA plate.
12. Incubated the ELISA plate at room temperature for 1 hour.
13. Diluted the p-nitrophenyl phosphate substrate solution in 1×DEA substrate buffer, pH 9.8 (KPL, Cat.#50-80-02) such that the final working dilution concentration is 1 mg/mL.
14. Washed the ELISA plate five times with wash buffer (1×TBS/0.05% TWEEN).
15. Added 100 µL of the diluted p-nitrophenyl phosphate substrate solution to the appropriate wells of the ELISA plate
16. Using plate reader, took the absorbance readings at 405 nm of the ELISA plate at 30, 60, 90, and 120 minute intervals.

Culture medium was applied to the ELISA either in an undiluted or slightly diluted manner. 3xFlag-hGH is detected in this assay. The 3xFlag-hGH levels were determined by reference to the 3xFlag-hGH standard curve and are presented in various figures throughout this application.

2. 3xFlag-hGH Detection with Immunocytochemistry

Transfected cells were fixed and examined using immunohostochemical techniques known to one of ordinary skill in the art. 3xFlag-hGH immunoreactivity was observed in the perinuclear cytoplasm of transfected LMH2a cells. Preabsorption of the anti-GH antiserum with GH prevented staining of the transfected cells.

Immunoreactivity to a 3xFlag-hGH fusion protein was detected in transfected tubular gland cells using anti-3xflag-FITC primary antiserum.

3. 3xFlag-hGH Production

Several experiments were conducted to compare the backbone vectors containing the same gene of interest. For GH expression in tubular gland cells, significant differences were observed when protein expression was driven by the ovalbumin promoter. For example, the ovalbumin-hGH gene in TnMAR (SEQ ID NO:26) expressed at a rate 25% to 40% more than the same gene construct in the TnHS4 vector (SEQ ID NO:24) but was only 5% better than the same gene construct in the LysRep vs 2 vector (SEQ ID NO:25).

For protein expression in cultures of LMH2A cells, we developed a vector that allows selection of the cells expressing only the protein of interest. This selection vector contains a gene expressing the antibiotic puromycin, an antibiotic that is toxic to eukaryotic cells. The gene is contained within the insertion sequences of the transposon gene, so it is inserted with the Transposon gene and gene of interest. The antibiotic puromycin is added initially to transfected cells at a rate of 1 µg/ml to begin the selection process. The concentration is gradually raised in 0.25 µg/ml increments until a maximum of 2.0 µg/ml is reached. The cells do not produce much protein at this high puromycin concentration, but the puromycin kills any non-transfected cells. Once the non-transfected cells are killed, the concentration was decreased to 1.25-1.5 µg/ml to resume protein production.

This vector is called TnPuro (SEQ ID NO:7) (followed by the designation of the insulator elements; in this case TnPuro MAR (SEQ ID NO:8). MAR designates Matrix Attachment Region) and has a multiple cloning site downstream of the puro gene to facilitate cloning of the gene of interest (GOI). To determine if the orientation of the GOI with respect to the puromycin gene had an effect, two vectors were constructed in the TnPuro MAR backbone; one in which the puromycin/GOI were tail to head (poly A to promoter (SEQ ID NO:29), and the second in which the two genes were tail to tail (poly A to polyA (SEQ ID NO:28). The tail to tail version produced 3.4 times more protein than the tail to head version (52.5 µg/ml compared to 15.5 µg/ml).

Using tubular gland cell culture, each backbone vector was tested using the ovalbumin promoter/hGH as the GOI. Again, the TnMAR (SEQ ID NO:26) produced as much as 40% more protein as the backbone vector using the HS4 insulator elements and, in this experiment, it produced about 37% more protein than the CMV promoter/hGH vector using the HS4 insulators (data not shown).

In specific embodiments, the disclosed backbone vectors are defined by the following annotations:

SEQ ID NO:1 pTnMCS (Base Vector, without MCS Extension) Vector #5001

Bp 1-130 Remainder of F1 (−) on of pBluescriptII sk(−) (Stratagene) bp1-130
Bp 133-1812 CMV promoter/enhancer taken from vector pGWIZ (Gene Therapy Systems) bp229-1873
Bp 1813-3018 Transposase, modified from Tn10 (GeneBank accession #J01829) Bp 108-1316
Bp 3019-3021 Engineered stop codon
Bp 3022-3374 Non-coding DNA from vector pNK2859
Bp 3375-3417 Lambda DNA from pNK2859
Bp 3418-3487 70 bp of IS10 left from Tn10
Bp 3494-3700 Multiple cloning site from pBluescriptII sk(−), thru the XmaI site Bp 924-718
Bp 3701-3744 Multiple cloning site from pBluescriptII sk(−), from the XmaI site thru the XhoI site. These base pairs are usually lost when cloning into pTnMCS. Bp 717-673
Bp 3745-4184 Multiple cloning site from pBluescriptII sk(−), from the XhoI site bp 672-235
Bp 4190-4259 70 bp of IS10 from Tn10
Bp 4260-4301 Lambda DNA from pNK2859
Bp 4302-5167 Non-coding DNA from pNK2859
Bp 5168-7368 pBluescriptII sk(−) base vector (Stratagene, INC) bp 761-2961
SEQ ID NO: 2 pTnX-MCS (Vector #5005) (pTNMCS (Base Vector) with MCS Extension)

Bp 1-132 Remainder of F1 (−) on of pBluescriptII sk(−) (Stratagene) Bp 4-135
Bp 133-1785 CMV Promoter/Enhancer from vector pGWIZ (Gene Therapy Systems)
Bp 1786-3018 Transposase, modified from Tn10 (GeneBank accession #J01829) Bp 81-1313
Bp 3019-3021 Engineered stop codon
Bp 3022-3374 Non-coding DNA from vector pNK2859
Bp 3375-3416 Lambda DNA from pNK2859
Bp 3417-3486 70 bp of IS10 left from Tn10 (GeneBank accession #J01829 Bp 1-70)
Bp 3487-3704 Multiple cloning site from pBluescriptII sk(−), thru XmaI
Bp 3705-3749 Multiple cloning site from pBluescriptII sk(−), from XmaI thru XhoI
Bp 3750-3845 Multiple cloning site extension from XhoI thru PspOMI
BP 3846-4275 Multiple cloning site from pBluescriptII sk(−), from PspOMI
Bp 4276-4345 70 bp of IS10 from Tn10 (GeneBank accession #J01829 Bp 70-1)
Bp 4346-4387 Lambda DNA from pNK2859
Bp 4388-5254 Non-coding DNA from pNK2859
Bp 5255-7455 pBluescriptII sk(−) base vector (Stratagene, INC) Bp 761-2961
SEQ ID NO: 3 HS4 Flanked BV (Vector #5006)
Bp 1-132 Remainder of F1 (−) on of pBluescriptII sk(−) (Stratagene) Bp 4-135
Bp 133-1785 CMV Promoter/Enhancer from vector pGWIZ (Gene Therapy Systems) Bp 229-1873, including the combination of 2 NruI cut sites
Bp 1786-3018 Transposase, modified from Tn10 (GeneBank accession #J01829) Bp 81-1313
Bp 3019-3021 Engineered stop codon
Bp 3022-3374 Non-coding DNA from vector pNK2859
Bp 3375-3416 Lambda DNA from pNK2859
Bp 3417-3490 70 bp of IS10 left from Tn10 (GeneBank accession #J01829 Bp 1-70)
Bp 3491-3680 Multiple cloning site from pBluescriptII sk(−), thru NotI Bp 926-737
Bp 3681-4922 HS4—Beta-globin Insulator Element from Chicken gDNA
Bp 4923-5018 Multiple cloning site extension XhoI thru MluI
Bp 5019-6272 HS4—Beta-globin Insulator Element from Chicken gDNA
Bp 6273-6342 70 bp of IS10 from Tn10 (GeneBank accession #J01829 Bp 70-1)
Bp 6343-6389 Lambda DNA from pNK2859
Bp 6390-8590 pBluescriptII sk(−) base vector (Stratagene, INC) Bp 761-2961
SEQ ID NO: 4 pTn-10 HS4 Flanked Backbone (Vector #5012)
Bp. 1-132 Remaining of F1 (−) On from pBluescript II sk(−) (Statagene Bp 4-135).
Bp. 133-1806 CMV Promoter/Enhancer from vector pGWIZ (Gene Therapy Systems) Bp. 229-1873.
Bp. 1807-3015 Tn-10 transposase, from pNK2859 (GeneBank accession #J01829 Bp. 81-1313).
Bp. 3016-3367 Non-coding DNA, possible putative poly A, from vector pNK2859.
Bp. 3368-3410 Lambda DNA from pNK2859.
Bp. 3411-3480 70 bp of IS10 left from Tn10 (GeneBank accession #J01829 bp. 1-70
Bp. 3481-3674 Multiple cloning site from pBluescript II sk(−), thru NotI Bp. 926-737.
Bp. 3675-4916 Chicken Beta Globin HS4 Insulator Element (Genbank Accession #NW_060254.0).
Bp. 4917-5012 Multiple cloning site extension Xho I thru Mlu I.
Bp. 5013-6266 Chicken Beta Globin HS4 Insulator Element (Genbank Accession #NW_060254.0).
Bp. 6267-6337 70 bp of IS10 left from Tn10 (GeneBank accession #J01829 bp. 1-70
Bp. 6338-6382 Lambda DNA from pNK2859.
Bp. 6383-8584 pBluescript II sk(−) Base Vector (Stratagene, Inc. Bp. 761-2961).
SEQ ID NO: 5 pTn10 MAR Flanked BV (Vector 5018)
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3' end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Lysozyme Matrix Attachment Region (MAR)
Bp 5368-5463 Multiple Cloning Site Extension from pTn X-MCS, XhoI thru MluI
Bp 5464-7168 Lysozyme Matrix Attachment Region (MAR)
Bp 7169-7238 70 bp of IS10 from Tn10 (GenBank Accession #J01829 Bp 70-1)
Bp 7239-7281 Lambda DNA from pNK2859
Bp 7282-9486 pBluescriptII sk(−) base vector (Stratagene, INC)
SEQ ID NO:6 Vector 5020; pTn10 PURO—LysRep2 Flanked BV
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3' end from Genbank Accession #J01829 bp79-107
Bp 1807-3015 Transposon, modified from Tn10 GenBank Accession #J01829 Bp 108-1316

Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3484 Synthetic DNA added during construction
Bp 3485-3651 pBluescriptII sk(−) base vector (Stratagene, INC) bp 926-760
Bp 3652-3674 Multiple cloning site from pBluescriptII sk(−) thru NotI, Bp 759-737
Bp 3675-4608 Lysozyme Rep2 from gDNA (corresponds to Genbank Accession #NW_060235)
Bp 4609-4686 Multiple Cloning Site Extension from pTn X-MCS, XhoI thru BsiWI
Bp 4687-4999 HSV-TK polyA from pS65TC1 bp 3873-3561
Bp 5000-5028 Excess DNA from pMOD PURO (invivoGen)
BP 5029-5630 Puromycin resistance gene from pMOD PURO (invivoGen) bp 717-116
Bp 5631-6016 SV40 promoter from pS65TC1, bp 2232-2617
Bp 6017-6022 MluI RE site
Bp 6023-6956 Lysozyme Rep2 from gDNA (corresponds to Genbank Accession #NW_060235)
Bp 6957-6968 Synthetic DNA added during construction including a PspOMI RE site
Bp 6969-7038 70 bp of IS10 from Tn10 (GenBank Accession #J01829 Bp 70-1)
Bp 7039-7081 Lambda DNA from pNK2859
Bp 7082-7085 Synthetic DNA added during construction
Bp 7086-9286 pBluescriptII sk(−) base vector (Stratagene, INC) bp 761-2961
SEQ ID NO: 8 Vector #5021; pTn10 PURO—MAR Flanked BV
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3' end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Lysozyme Matrix Attachment Region (MAR)
Bp 5368-5445 Multiple Cloning Site Extension from pTn X-MCS, XhoI thru BsiWI
Bp 5446-5758 HSV-TK polyA from pS65TC1 bp 3873-3561
BP 5759-6389 Puromycin resistance gene from pMOD PURO (invivoGen)
Bp 6390-6775 SV40 promoter from pS65TC1, bp 2232-2617
Bp 6776-8486 Lysozyme Matrix Attachment Region (MAR)
Bp 8487-8556 70 bp of IS10 from Tn10 (GenBank Accession #J01829 Bp 70-1)
Bp 8557-8599 Lambda DNA from pNK2859
Bp 8600-10804 pBluescriptII sk(−) base vector (Stratagene, INC)
SEQ ID NO:9 Vector #5022; pTn10 Gen—MAR Flanked BV
Bp 1-5445 pTn10 MAR Flanked BV, ID #5018
Bp 5446-5900 HSV-TK polyA from Taken from pIRES2-ZsGreen1, bp 4428-3974
Bp 5901-6695 Kanamycin/Neomycin (G418) resistance gene, taken from pIRES2-ZsGreen1, Bp 3973-3179
Bp 6696-7046 SV40 early promoter/enhancer taken from pIRES2-ZsGreen1, bp 3178-2828
Bp 7047-7219 Bacterial promoter for expression of KAN resistance gene, taken from pIRES2-ZsGreen1, bp 2827-2655
Bp 7220-11248 pTn10 MAR Flanked BV, bp 5458-9486
SEQ ID NO: 10 pTn10 MAR Flanked BV; Vector #5024
Bp 1-132 Remainder of F1 (−) on of pBluescriptII sk(−) (Stratagene) bp 4-135
Bp 133-154 pGWIZ base vector (Gene Therapy Systems) bp 229-244
Bp 155-229 CMV promoter (from vector pGWIZ, Gene Therapy Systems bp 844-918)
Bp 230-350 CMV Immediate Early Gene, Exon 1 (vector pGWIZ, Gene Therapy Systems bp 919-1039)
Bp 351-1176 CMV Intron A (vector pGWIZ, Gene Therapy Systems bp 1040-1865)
Bp 1177-1184 CMV Immediate Early Gene, Partial Exon 2 (pGWIZ, Gene Therapy Systems) bp 1866-1873)
Bp 1185-1213 TN10 DNA, 3' end from Genbank Accession #J01829 bp79-107
Bp 1214-2422 Transposon, modified from Tn10 GenBank Accession #J01829 bp 108-1316
Bp 2423-2774 Putative PolyA from vector pNK2859
Bp 2775-2817 Lambda DNA from pNK2859
Bp 2818-2887 70 bp of IS10 left from Tn10 (GenBank Accession #J01829 Bp 1-70)
Bp 2888-3058 pBluescriptII sk(−) base vector (Stratagene, INC) Bp 3059-3081 Multiple cloning site from pBluescriptII sk(−) thru NotI,
Bp 3082-4774 Chicken 5' Lysozyme Matrix Attachment Region (MAR) from chicken gDNA corresponding to GenBank Accession #X98408
Bp 4775-4870 Multiple Cloning Site Extension from pTn X-MCS, XhoI thru MluI
Bp 4871-6575 Chicken 3' Lysozyme Matrix Attachment Region (MAR) from chicken gDNA corresponding to GenBank Accession #X98408
Bp 6576-6645 70 bp of IS10 from Tn10 (GenBank Accession #J01829 Bp 70-1)
Bp 6646-6688 Lambda DNA from pNK2859
Bp 6689-8893 pBluescriptII sk(−) base vector (Stratagene, INC)
SEQ ID NO: 11 Vector #5025; pTn10 (−CMV Enh.)PURO—MAR Flanked BV
Bp 1-132 Remainder of F1 (−) on of pBluescriptII sk(−) (Stratagene) bp 4-135
Bp 133-154 pGWIZ base vector (Gene Therapy Systems) bp 229-244
Bp 155-229 CMV Promoter (vector pGWIZ, Gene Therapy Systems bp 844-918)
Bp 230-350 CMV Immediate Early Gene, Exon 1 (vector pGWIZ, Gene Therapy Systems bp 919-1039)
Bp 351-1176 CMV Intron A (vector pGWIZ, Gene Therapy Systems bp 1040-1865)
Bp 1177-1184 CMV Immediate Early Gene, Partial Exon 2 (pGWIZ, Gene Therapy Systems) bp 1866-1873)

Bp 1185-1213 TN10 DNA, 3' end from Genbank Accession #J01829 bp79-107
Bp 1214-2422 Transposon, modified from Tn10 GenBank Accession #J01829 Bp 108-1316
Bp 2423-2774 Putative PolyA from vector pNK2859
Bp 2775-2817 Lambda DNA from pNK2859
Bp 2818-2887 70 bp of IS10 left from Tn10 (GenBank Accession #J01829 Bp 1-70)
Bp 2888-3058 pBluescriptII sk(−) base vector (Stratagene, INC)
Bp 3059-3081 Multiple cloning site from pBluescriptII sk(−) thru NotI, Bp 759-737
Bp 3082-4774 Lysozyme Matrix Attachment Region (MAR) from chicken gDNA corresponding to GenBank Accession #X98408
Bp 4775-4852 Multiple Cloning Site Extension from pTn X-MCS, XhoI thru BsiWI
Bp 4853-5165 HSV-TK polyA from pS65TC1 bp 3873-3561
BP 5166-5796 Puromycin resistance gene from pMOD PURO (invivoGen)
Bp 5797-6182 SV40 promoter from pS65TC1, bp 2232-2617
Bp 6183-7893 Lysozyme Matrix Attachment Region (MAR)
Bp 7894-7963 70 bp of IS10 from Tn10 (GenBank Accession #J01829 Bp 70-1)
Bp 7964-8010 Lambda DNA from pNK2859
Bp 8011-10211 pBluescriptII sk(−) base vector (Stratagene, INC) bp 761-2961
SEQ ID NO: 12 Vector #5026; pTn10 MAR Flanked BV
Bp 1-132 Remainder of F1 (−) on of pBluescriptII sk(−) (Stratagene) bp 4-135
Bp 133-154 pGWIZ base vector (Gene Therapy Systems) bp 229-244
Bp 155-540 SV40 promoter from pS65TC1 bp 2232-2617
Bp 541-661 CMV Immediate Early Gene, Exon 1 (vector pGWIZ, Gene Therapy Systems bp 919-1039)
Bp 662-1487 CMV Intron A (vector pGWIZ, Gene Therapy Systems bp 1040-1865)
Bp 1488-1495 CMV Immediate Early Gene, Partial Exon 2 (pGWIZ, Gene Therapy Systems) bp 1866-1873)
Bp 1496-1524 TN10 DNA, 3' end from Genbank Accession #J01829 bp79-107
Bp 1525-2733 Transposon, modified from Tn10 GenBank Accession #J01829 bp 108-1316
Bp 2734-3085 Putative PolyA from vector pNK2859
Bp 3086-3128 Lambda DNA from pNK2859
Bp 3129-3198 70 bp of IS10 left from Tn10 (GenBank Accession #J01829 Bp 1-70)
Bp 3199-3369 pBluescriptII sk(−) base vector (Stratagene, INC)
Bp 3370-3392 Multiple cloning site from pBluescriptII sk(−) thru NotI, Bp 759-737
Bp 3393-5085 Chicken 5' Lysozyme Matrix Attachment Region (MAR) from chicken gDNA corresponding to GenBank Accession #X98408
Bp 5086-5181 Multiple Cloning Site Extension from pTn X-MCS, XhoI thru MluI
Bp 5182-6886 Chicken 3' Lysozyme Matrix Attachment Region (MAR) from chicken gDNA corresponding to GenBank Accession #X98408
Bp 6887-6956 70 bp of IS10 from Tn10 (GenBank Accession #J01829 Bp 70-1)
Bp 6957-6999 Lambda DNA from pNK2859
Bp 7000-9204 pBluescriptII sk(−) base vector (Stratagene, INC)
SEQ ID NO: 13 pTn10 SV 40 Pr.PURO—MAR Flanked BV (Vector #5027)

Bp 1-132 Remainder of F1 (−) on of pBluescriptII sk(−) (Stratagene) bp 4-135
Bp 133-154 pGWIZ base vector (Gene Therapy Systems) bp 229-244
Bp 155-540 SV40 Promoter from pS65TC1, Bp 2232-2617
Bp 541-661 CMV Immediate Early Gene, Exon 1 (vector pGWIZ, Gene Therapy Systems bp 919-1039)
Bp 662-1487 CMV Intron A (vector pGWIZ, Gene Therapy Systems bp 1040-1865)
Bp 1488-1495 CMV Immediate Early Gene, Partial Exon 2 (pGWIZ, Gene Therapy Systems) bp 1866-1873)
Bp 1496-1524 TN10 DNA, 3' end from Genbank Accession #J01829 bp79-107
Bp 1525-2733 Transposon, modified from Tn10 GenBank Accession #J01829 Bp 108-1316
Bp 2734-3085 Putative PolyA from vector pNK2859
Bp 3086-3128 Lambda DNA from pNK2859
Bp 3129-3198 70 bp of IS10 left from Tn10 (GenBank Accession #J01829 Bp 1-70)
Bp 3199-3369 pBluescriptII sk(−) base vector (Stratagene, INC)
Bp 3370-3392 Multiple cloning site from pBluescriptII sk(−) thru NotI, Bp 759-737
Bp 3393-5085 Lysozyme Matrix Attachment Region (MAR) from chicken gDNA GenBank Accession #X98408.
Bp 5086-5163 Multiple Cloning Site Extension from pTn X-MCS, XhoI thru BsiWI
Bp 5164-5476 HSV-TK polyA from pS65TC1 bp 3873-3561
BP 5477-6107 Puromycin resistance gene from pMOD PURO (invivoGen)
Bp 6108-6499 SV40 promoter from pS65TC1, bp 2232-2617
Bp 6500-8204 Lysozyme Matrix Attachment Region (MAR)
Bp 8205-8274 70 bp of IS10 from Tn10 (GenBank Accession #J01829 Bp 70-1)
Bp 8275-8317 Lambda DNA from pNK2859
Bp 8318-10522 pBluescriptII sk(−) base vector (Stratagene, INC) bp 761-2961

In specific embodiments, the disclosed hybrid promoters are defined by the following annotations:
SEQ ID NO:14 (CMV/Oval Promoter Version 1=ChOvp/CMVenh/CMVp)
Bp 1-840: corresponds to bp 421-1260 from the chicken ovalbumin promoter, GenBank accession number
Bp 841-1439: CMV Enhancer bp 245-843 taken from vector pGWhiz CMV promoter and enhancer bp 844-918 taken from vector pGWhiz (includes the CAAT box at 857-861 and the TATA box at 890-896).
Bp 1440-1514 CMV promoter
SEQ ID NO:15 (CMV/Oval Promoter Version 2=ChSDRE/CMVenh/ChNRE/CMVp)
Bp 1-180: Chicken steroid dependent response element from ovalbumin promoter
Bp 181-779: CMV Enhancer bp 245-843 taken from vector pGWhiz
Bp 780-1049: Chicken ovalbumin promoter negative response element
Bp 1050-1124: CMV promoter bp 844-918 taken from vector pGWhiz (includes the CAAT box at 857-861 and the TATA box at 890-896. Some references overlap the enhancer to different extents.)

In specific embodiments, the disclosed expression vectors are defined by the following annotations:
SEQ ID NO:17 (Vector #153) HS4 Flanked Backbone Vector (CMV.Ovalp vs. 1)
Bp 1-4936 HFBV
Bp 4937-5782 Chicken Ovalbumin enhanced promoter (bp 1090-1929) w/EcoRI site at 3' end for ligation Bp 5783-6437 CMVenhancer/promoter (bp 245-899 of gWIZ blank vector)
Bp 6438-6459 XhoI site+bp 900-918 of CMVpromoter from gWIZ blank vector (site used to add on the CMViA')
Bp 6460-7420 CMV intron A' (bp 919-1873 of gWIZ; includes CMV immediate-early gene, Exon1; CMV intron A; CMV immediate-early gene, partial Exon 2)+SalI cut site for ligation
Bp 7421-7489 Chicken Conalbumin Signal Sequence+ Kozak sequence 7421-7426 (from GenBank Accession # X02009)+BsrFI site for ligation
Bp 7490-7540 3x flag
Bp 7541-7555 Enterokinase Cleavage Site
Bp 7556-8137 Human Growth Hormone, for Chicken from GenBank Accession #V00520, bp 140-715 (start codon and signal sequence omitted)+AatII site at 3' end for ligation
Bp 8138-9054 Chicken Ovalbumin PolyA site (GenBank Accession # J00895 bp 8260-9176)
Bp 9055-10038 Chicken Ovalbumin PolyA Extension (GenBank Accession X01422 bp 271-1255)
Bp 10039-13675 HFBV (bp 4954-8590)
SEQ ID NO:18 Vector #173; HS4 Flanked Backbone Vector (CMV Ovalp. vs. 2)
Bp 1-4936 HS4 Flanked Backbone vector
Bp 4937-5122 Chicken SDRE (from ChOVep, bp 1100-1389) with EcoRI site at 3' end for ligations (bp 5117-5122)
Bp 5123-5727 CMVenhancer (from gWIZ blank vector, bp 245-843) with NgoMIV site at 3' end for ligations (5721-5727)
Bp 5728-6003 Chicken NRE (from ChOvep, bp 1640-1909) with KpnI site at 3' end for ligations (bp 5998-6003)
Bp 6004-6081 CMVpromoter (from gWIZ blank vector, bp 844-915); has XhoI site from vector (inserted "CTC" at bp 6060 to create XhoI site to ligate vector to CMViA').
Bp 6082-7042 CMV Intron A' (CMV immediate early gene, exon 1; CMV IntronA; CMV immediate early gene, partial exon 2); from gWIZ blank vector bp 919-1873, with SalI site at 3' end for ligation (bp 7037-7042)
Bp 7043-7111 Chicken Conalbumin Signal Sequence+ Kozak sequence 7043-7048 (from GenBank Accession # X02009)+BsrFI site for ligation
Bp 7112-7162 3x flag
Bp 7163-7177 Enterokinase Cleavage Site
Bp 7178-7759 Human Growth Hormone, for Chicken from GenBank Accession #V00520, bp 140-715 (start codon and signal sequence omitted)+AatII site at 3' end for ligation
Bp 7760-8675 Chicken Ovalbumin PolyA site (GenBank Accession # J00895 bp 8260-9176)
Bp 8676-9660 Chicken Ovalbumin PolyA Extension (GenBank Accession # X01422 bp 271-1255)
Bp 9661-13297 HS4 flanked Backbone vector (bp 4954-8590)
SEQ ID NO:19 (Vector #174 HS4 Flanked Backbone Vector (CMV.Ovalp vs. 3)
Bp 1-4936 HS4 Flanked Backbone vector (bp 1-4936)
Bp 4937-5542 CMVenhancer (from gWIZ blank vector, bp 245-843) with NgoMIV site at 3' end
Bp 5543-6387 Chicken Ovalbumin promoter (contains CH SDRE, promoter, NRE) bp 1090-1929 of CHOvep; with KpnI site at the 3' end
Bp 6388-6465 CMVpromoter (from gWIZ blank vector, bp 844-915); has XhoI site from vector (inserted "CTC" at bp 6060 to create XhoI cut to ligate clone 10 to CMViA').
Bp 6466-7426 CMV Intron A' (CMV immediate early gene, exon 1; CMV IntronA; CMV immediate early gene, partial exon 2); from gWIZ blank vector bp 919-1873, with SalI site at 3' end for ligation (bp 7037-7042)
Bp 7427-7495 Chicken Conalbumin Signal Sequence+ Kozak sequence (7427-7432) (from GenBank Accession # X02009)+BsrFI site for ligation
Bp 7496-7546 3x flag
Bp 7547-7561 Enterokinase Cleavage Site
Bp 7562-8143 Human Growth Hormone, for Chicken from GenBank Accession #V00520, bp 140-715 (start codon and signal sequence omitted)+AatII site at 3' end for ligation
Bp 8144-9059 Chicken Ovalbumin PolyA site (GenBank Accession # J00895 bp 8260-9176)
Bp 9060-10044 Chicken Ovalbumin PolyA Extension (GenBank Accession #X01422 bp 271-1255)
Bp 10045-13681 HS4 flanked Backbone vector (bp 4954-8590)
SEQ ID NO:20 (#157) HS4 Flanked Backbone with OV enh/prom./OV ia/OVg' FL/nrs/3xF/co-hGH/OV ext.PA)
Bp 1-132 Remaining of F1 (−) On from pBluescript II sk(−) Statagene Bp 4-135).
Bp 133-1812 CMV Promoter/Enhancer from vector pGWIZ (Gene Therapy Systems) Bp. 229-1873.
Bp 1813-3021 Tn-10 transposase, from pNK2859 (GeneBank accession #J01829 Bp. 81-1313).
Bp 3022-3373 Non-coding DNA, possible putative poly A, from vector pNK2859.
Bp 3374-3416 Lambda DNA from pNK2859.
Bp 3417-3486 70 bp of IS10 left from Tn10 (GeneBank accession #J01829 bp. 1-70
Bp 3487-3680 Multiple cloning site from pBluescript II sk(−), thru NotI Bp. 926-737.
Bp 3681-4922 Chicken Beta Globin HS4 Insulator Element (Genbank accession #NW_060254.0).
Bp 4923-4931 Multiple cloning site extension Xho I thru Asc I.
Bp 4932-5600 Chicken Ovalbumin Enhancer GenBank Accession Number J00895.
Bp 5601-6950 Chicken Ovalbumin Promoter GenBank accession #J00895 and M24999
Bp 6951-9756 Chicken Ovalbumin full length gene with IntronA Included. (GeneBank accession # J00895). Kozak (8598-8603).
Bp 9757-9817 Synthetically produced New Rotational Spacer.
Bp 9818-9883 3xFlag with Enterokinase Cleavage Site
Bp 9884-10461 human Growth Hormone for Chicken (Genbank accession #V00520 bp. 140-715, Start codon and signal sequence omitted)
Bp 10462-12362 Chicken Ovalbumin Extended Poly A(genbank accession # J00895 and X01422.)
Bp 12363-12422 Multiple cloning site extension Pac I thru Mlu I.
Bp 12423-13676 Chicken Beta Globin HS4 Insulator Element (Genbank accession #NW_060254.0).
Bp 13677-13747 70 bp of IS10 left from Tn10 (GeneBank accession #J01829 bp. 1-70
Bp 13748-13793 Lambda DNA from pNK2859.
Bp 13794-15994 pBluescript II sk(−) Base Vector (Stratagene, Inc. Bp. 761-2961).
SEQ ID NO:21 ((#181) pTn-10 HS4 Flanked Backbone with OV enh/prom./OV ia/OVg' FL/nrs/3XF/co-hGH/OV ext.PA)
Bp 1-132 Remaining of F1 (−) On from pBluescript II sk(−) (Statagene Bp 4-135).
Bp 133-1806 CMV Promoter/Enhancer from vector pGWIZ (Gene Therapy Systems) Bp. 229-1873.

Bp 1807-3015 Tn-10 transposase, from pNK2859 (GeneBank accession #J01829 Bp. 81-1313).
Bp 3016-3367 Non-coding DNA, possible putative poly A, from vector pNK2859.
Bp 3368-3410 Lambda DNA from pNK2859.
Bp 3411-3480 70 bp of IS10 left from Tn10 (GeneBank accession #J01829 bp. 1-70
Bp 3481-3674 Multiple cloning site from pBluescript II sk(−), thru NotI Bp. 926-737.
Bp 3675-4916 Chicken Beta Globin HS4 Insulator Element (Genbank accession #NW_060254.0).
Bp 4917-4924 Multiple cloning site extension Xho I thru Asc I.
Bp 4925-5594 Chicken Ovalbumin Enhancer GenBank Accession Number J00895.
Bp 5595-6944 Chicken Ovalbumin Promoter GenBank accession #J00895 and M24999
Bp 6945-9751 Chicken Ovalbumin full length gene with Intron A Included. (Gene Bank accession # J00895). Kozak sequence (Bp 8592-8597)
Bp 9752-9811 Synthetically produced New Rotational Spacer.
Bp 9812-9877 3xFlag with Enterokinase Cleavage Site
Bp 9878-10458 human Growth Hormone for Chicken (Genbank accession #V00520 bp. 140-715, Start codon and signal sequence omitted)
Bp 10459-12356 Chicken Ovalbumin Extended Poly A(genbank accession # J00895 and X01422.)
Bp 12357-12416 Multiple cloning site extension Pac I thru Mlu I.
Bp 12417-13671 Chicken Beta Globin HS4 Insulator Element (Genbank accession #NW_060254.0).
Bp 13672-13741 70 bp of IS10 left from Tn10 (GeneBank accession #J01829 bp. 1-70
Bp 13742-13786 Lambda DNA from pNK2859.
Bp 13787-15988 pBluescript II sk(−) Base Vector (Stratagene, Inc. Bp. 761-2961).
SEQ ID NO:22 ((VID #170) pTn-10 HS4 Flanked Backbone with OV ehn/prom./OV ia/OVg' FL/nrs/3×F/co-hGH/OPA)
Bp 1-132 Remaining of F1 (−) On from pBluescript II sk(−) (Statagene Bp 4-135).
Bp 133-1806 CMV Promoter/Enhancer from vector pGWIZ (Gene Therapy Systems) Bp. 229-1873.
Bp 1807-3015 Tn-10 transposase, from pNK2859 (GeneBank accession #J01829 Bp. 81-1313).
Bp 3016-3367 Non-coding DNA, possible putative poly A, from vector pNK2859.
Bp 3368-3410 Lambda DNA from pNK2859.
Bp 3411-3480 70 bp of IS10 left from Tn10 (GeneBank accession #J01829 bp. 1-70
Bp 3481-3674 Multiple cloning site from pBluescript II sk(−), thru NotI Bp. 926-737.
Bp 3675-4916 Chicken Beta Globin HS4 Insulator Element (Genbank accession #NW_060254.0).
Bp 4917-4924 Multiple cloning site extension Xho I thru Asc I.
Bp 4925-5594 Chicken Ovalbumin Enhancer GenBank Accession Number J00895.
Bp 5595-6944 Chicken Ovalbumin Promoter GenBank accession #J00895 and M24999
Bp 6945-9751 Chicken Ovalbumin full length gene with Intron A Included. (Gene Bank accession # J00895). Kozak sequence (Bp 8592-8597)
Bp 9752-9811 Synthetically produced New Rotational Spacer.
Bp 9812-9877 3xFlag with Enterokinase Cleavage Site
Bp 9878-10458 human Growth Hormone for Chicken (Genbank accession #V00520 bp. 140-715, Start codon and signal sequence omitted)
Bp 10459-11387 Chicken Ovalbumin Regular length Poly A(genbank accession # J00895 and X01422.)
Bp 11388-11447 Multiple cloning site extension Pac I thru Mlu I.
Bp 11448-12701 Chicken Beta Globin HS4 Insulator Element (Genbank accession #NW_060254.0).
Bp 12702-12772 70 bp of IS10 left from Tn10 (GeneBank accession #J01829 bp. 1-70
Bp 12773-12817 Lambda DNA from pNK2859.
Bp 12818-15019 pBluescript II sk(−) Base Vector (Stratagene, Inc. Bp. 761-2961).
SEQ ID NO:23 (#159; Ovep-hGH-OVexpA—C1.10 cass in HS4 Flanked BV)
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1785 Synthetic DNA added during construction (combination of two NruI RE sites)
Bp 1786-3021 Transposase Tn10 GenBank Accession #J01829 Bp 81-1316
Bp 3022-3373 Non-coding DNA from vector pNK2859
Bp 3374-3416 Lambda DNA from pNK2859
Bp 3417-3486 70 bp of IS10 left from Tn10 (GenBank Accession #J01829 Bp 1-70)
Bp 3487-3490 Synthetic DNA added during construction
Bp 3491-3657 pBluescriptII sk(−) base vector (Stratagene, INC) bp 926-760
Bp 3658-3680 Multiple cloning site from pBluescriptII sk(−) thru NotI, Bp 759-737
Bp 3681-4922 Chicken HS4-Beta Globin enhancer element from genomic (g)DNA (corresponds to Genbank Accession #NW_060254 bp 215169-216410)
Bp 4923-4936 Multiple Cloning Site Extension from pTn X-MCS, XhoI thru AscI
Bp 4937-5600 Chicken Ovalbumin Enhancer from gDNA (corresponds to Genbank Accession #AH003855 bp 13-675)
Bp 5601-6942 Chicken Ovalbummin Promoter from gDNA (corresponds to Genbank Accession #J00895 bp 1-1337)
Bp 6943-6948 XhoI RE site
Bp 6949-6964 pGWIZ base vector (Gene Therapy Systems) bp 903-918
Bp 6965-7085 CMV Immediate Early Gene, Exon 1 (vector pGWIZ, Gene Therapy Systems bp 919-1039)
BP 7086-7911 CMV Intron A (vector pGWIZ, Gene Therapy Systems bp 1040-1865)
Bp 7912-7919 CMV Immediate Early Gene, Partial Exon 2 (pGWIZ, Gene Therapy Systems) bp 1866-1873)
Bp 7920-7928 SalI RE site and Conalbumin Kozak sequence (Bp 7926-7931)
Bp 7929-7988 Conalbumin Signal Peptide (corresponds to Genbank Accession #Y00407 bp 343-385, 1699-1715)

Bp 7989-7994 Synthetic DNA added during construction (destroyed NgOMIV RE site)
Bp 7995-8045 3xFlag—no rotational spacer
Bp 8046-8060 Enterokinase cleavage site
Bp 8061-8636 Human Growth Hormone from GenBank Accession #V00520, bp 140-715 (start codon and ss omitted)
Bp 8637-8642 AatII RE site
Bp 8643-10533 Chicken Ovalbumin Extended PolyA from gDNA
Bp 10534-10598 MCS extension from pTN-MCS, PacI thru MluI
Bp 10599-11840 Chicken HS4-Beta Globin enhancer element from gDNA (corresponds to Genbank Accession #NW_060254 bp 215169-216410)
Bp 11841-11852 Synthetic DNA added during construction including a PspOMI RE site
Bp 11853-11922 70 bp of IS10 from Tn10 (GenBank Accession #J01829 Bp 70-1)
Bp 11923-11965 Lambda DNA from pNK2859
Bp 11966-11969 Synthetic DNA added during construction
Bp 11970-14170 pBluescriptII sk(−) base vector (Stratagene, INC) bp 761-2961
SEQ ID NO:24 (#202—Ovep-hGH-OVexpA—C1.10 cass in pTn-10 HS4 Flanked BV)
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3' end from Genbank Accession #J01829 bp79-107
Bp 1807-3015 Transposon Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3484 Synthetic DNA added during construction
Bp 3485-3651 pBluescriptII sk(−) base vector (Stratagene, INC) bp 926-760
Bp 3652-3674 Multiple cloning site from pBluescriptII sk(−) thru NotI, Bp 759-737
Bp 3675-4916 Chicken HS4-Beta Globin enhancer element from gDNA (corresponds to Genbank Accession #NW_060254 bp 215169-216410)
Bp 4917-4930 Multiple Cloning Site Extension from pTn X-MCS, XhoI thru AscI
Bp 4931-5593 Chicken Ovalbumin Enhancer from gDNA (corresponds to Genbank Accession #AH003855 bp 13-675)
Bp 5594-5599 HindIII RE site
BP 5600-6936 Chicken Ovalbummin Promoter from gDNA (corresponds to Genbank Accession #J00895 bp 1-1337)
Bp 6937-6942 XhoI RE site
Bp 6943-6958 pGWIZ base vector (Gene Therapy Systems) bp 903-918

Bp 6959-7079 CMV Immediate Early Gene, Exon 1 (vector pGWIZ, Gene Therapy Systems bp 919-1039)
BP 7080-7905 CMV Intron A (vector pGWIZ, Gene Therapy Systems bp 1040-1865)
Bp 7906-7913 CMV Immediate Early Gene, Partial Exon 2 (pGWIZ, Gene Therapy Systems) bp 1866-1873)
Bp 7914-7922 SalI RE site and Conalbumin Kozak sequence (Bp 7920-7925)
Bp 7923-7982 Conalbumin Signal Peptide (corresponds to Genbank Accession #Y00407 bp 343-385, 1699-1715)
Bp 7983-7988 Synthetic DNA added during construction (destroyed NgOMIV RE site)
Bp 7989-8039 3xFlag—no rotational spacer
Bp 8040-8054 Enterokinase cleavage site
Bp 8055-8630 Human Growth Hormone from GenBank Accession #V00520, bp 140-715 (start codon and ss omitted)
Bp 8631-8636 AatII RE site
Bp 8637-9568 Chicken Ovalbumin 3'Exon 7 and polyA from gDNA (corresponds to GenBank Accession #J00829 bp 8260-9191)
Bp 9569-10527 Chicken Ovalbumin 3' terminus from gDNA (corresponds to GenBank Accession #X01422 bp 286-1244)
Bp 10528-10531 Synthetic DNA added during construction (destroyed PacI RE site)
Bp 10532-10588 MCS extension from pTN-MCS, KasI thru MluI
Bp 10589-11830 Chicken HS4-Beta Globin enhancer element from gDNA (corresponds to Genbank Accession #NW_060254 bp 215169-216410)
Bp 11831-11842 Synthetic DNA added during construction including a PspOMI RE site
Bp 11843-11912 70 bp of IS10 from Tn10 (GenBank Accession #J01829 Bp 70-1)
Bp 11913-11955 Lambda DNA from pNK2859
Bp 11956-11959 Synthetic DNA added during construction
Bp 11960-14160 pBluescriptII sk(−) base vector (Stratagene, INC) bp 761-2961
SEQ ID NO:25 (#203-Ovep-hGH-OVexpA—C1.10 cass in pTn-10 LysRep2 Flanked BV)
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3' end from Genbank Accession #J01829 bp79-107
Bp 1807-3015 Transposon Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3484 Synthetic DNA added during construction
Bp 3485-3651 pBluescriptII sk(−) base vector (Stratagene, INC) bp 926-760

Bp 3652-3674 Multiple cloning site from pBluescriptII sk(−) thru NotI, Bp 759-737
Bp 3675-4608 Lysozyme Rep2 from gDNA (corresponds to Genbank Accession #NW_060235)
Bp 4609-4622 Multiple Cloning Site Extension from pTn X-MCS, XhoI thru AscI
Bp 4623-5285 Chicken Ovalbumin Enhancer from gDNA (corresponds to Genbank Accession #AH003855 bp 13-675)
Bp 5286-5291 HindIII RE site
BP 5292-6628 Chicken Ovalbummin Promoter from gDNA (corresponds to Genbank Accession #J00895 bp 1-1337)
Bp 6629-6634 XhoI RE site
Bp 6635-6650 pGWIZ base vector (Gene Therapy Systems) bp 903-918
Bp 6651-6771 CMV Immediate Early Gene, Exon 1 (vector pGWIZ, Gene Therapy Systems bp 919-1039)
BP 6772-7597 CMV Intron A (vector pGWIZ, Gene Therapy Systems bp 1040-1865)
Bp 7598-7605 CMV Immediate Early Gene, Partial Exon 2 (pGWIZ, Gene Therapy Systems) bp 1866-1873)
Bp 7606-7614 SalI RE site and Conalbumin Kozak sequence (Bp 7612-7617)
Bp 7615-7674 Conalbumin Signal Peptide (corresponds to Genbank Accession #Y00407 bp 343-385, 1699-1715)
Bp 7675-7680 Synthetic DNA added during construction (destroyed NgOMIV RE site)
Bp 7681-7731 3xFlag—no rotational spacer
Bp 7732-7746 Enterokinase cleavage site
Bp 7747-8322 Human Growth Hormone from GenBank Accession #V00520, bp 140-715 (start codon and signal sequence omitted)
Bp 8323-8328 AatII RE site
Bp 8329-9260 Chicken Ovalbumin 3'Exon 7 and polyA from gDNA (corresponds to GenBank Accession #J00829 bp 8260-9191)
Bp 9261-10219 Chicken Ovalbumin 3' terminus from gDNA (corresponds to GenBank Accession #X01422 bp 286-1244)
Bp 10220-10266 MCS extension from pTN-MCS, PacI thru MluI
Bp 10267-11200 Lysozyme Rep2 from gDNA (corresponds to Genbank Accession #NW_060235)
Bp 11201-11212 Synthetic DNA added during construction including a PspOMI RE site
Bp 11213-11282 70 bp of IS10 from Tn10 (GenBank Accession #J01829 Bp 70-1)
Bp 11283-11325 Lambda DNA from pNK2859
Bp 11326-11329 Synthetic DNA added during construction
Bp 11330-13530 pBluescriptII sk(−) base vector (Stratagene, INC) bp 761-2961
SEQ ID NO:26 (ID #204-Ovep-hGH-OVexpA—C1.10 cass in pTn-10 MAR Flanked BV)
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3' end from Genbank Accession #J01829 bp79-107
Bp 1807-3015 Transposon Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3484 Synthetic DNA added during construction
Bp 3485-3651 pBluescriptII sk(−) base vector (Stratagene, INC) bp 926-760
Bp 3652-3674 Multiple cloning site from pBluescriptII sk(−) thru NotI, Bp 759-737
Bp 3675-5367 Chicken Lysozyme Matrix Attachment region (MAR) from gDNA
Bp 5368-5381 Multiple Cloning Site Extension from pTn X-MCS, XhoI thru AscI
Bp 5382-6044 Chicken Ovalbumin Enhancer from gDNA (corresponds to Genbank Accession #AH003855 bp 13-675)
Bp 6045-6050 HindIII RE site
BP 6051-7387 Chicken Ovalbummin Promoter from gDNA (corresponds to Genbank Accession #J00895 bp 1-1337)
Bp 7388-7393 XhoI RE site
Bp 7394-7409 pGWIZ base vector (Gene Therapy Systems) bp 903-918
Bp 7410-7530 CMV Immediate Early Gene, Exon 1 (vector pGWIZ, Gene Therapy Systems bp 919-1039)
BP 7531-8356 CMV Intron A (vector pGWIZ, Gene Therapy Systems bp 1040-1865)
Bp 8357-8364 CMV Immediate Early Gene, Partial Exon 2 (pGWIZ, Gene Therapy Systems) bp 1866-1873)
Bp 8365-8373 SalI RE site and Conalbumin Kozak sequence (Bp 8371-8376)
Bp 8374-8433 Conalbumin Signal Peptide (corresponds to Genbank Accession #Y00407 bp 343-385, 1699-1715)
Bp 8434-8439 Synthetic DNA added during construction (destroyed NgOMIV RE site)
Bp 8440-8490 3xFlag—no rotational spacer
Bp 8491-8505 Enterokinase cleavage site
Bp 8506-9081 Human Growth Hormone from GenBank Accession #V00520, bp 140-715 (start codon and ss omitted)
Bp 9082-9087 AatII RE site
Bp 9088-10019 Chicken Ovalbumin 3'Exon 7 and polyA from gDNA (corresponds to
GenBank Accession #J00829 bp 8260-9191)
Bp 10020-10978 Chicken Ovalbumin 3' terminus from gDNA (corresponds to GenBank Accession #X01422 bp 286-1244)
Bp 10979-10982 Synthetic DNA added during construction (destroyed PacI RE site)
Bp 10983-11039 MCS extension from pTN-MCS, KasI thru MluI
Bp 11040-12732 Chicken Lysozyme Matrix Attachment region (MAR) from gDNA
Bp 12733-12744 Synthetic DNA added during construction including a PspOMI RE site
Bp 12745-12814 70 bp of IS10 from Tn10 (GenBank Accession #J01829 Bp 70-1)
Bp 12815-12857 Lambda DNA from pNK2859
Bp 12858-12861 Synthetic DNA added during construction
Bp 12862-15062 pBluescriptII sk(−) base vector (Stratagene, INC) bp 761-2961
SEQ ID NO:27 (#171-HS4(CMVpr-iA-CONss-3xFlag-hGH.CO-synPA)HS4)
Bp 1-4922 HS4 flanked MCS backbone vector Bp 4923-4928 Restriction enzyme site, XhoI
Bp 4929-5542 CMV enhancer taken from pGWIZ (Gene therapy systems), bp 230-843.
Bp 5543-5617 CMV promoter taken from pGWIZ (Gene therapy systems), bp 844-918.
Bp 5618-5738 CMV Immediate early gene, Exon 1 taken from pGWIZ (Gene therapy systems), bp 919-1039.
Bp 5739-6564 CMV intron A taken from pGWIZ (Gene therapy systems), bp 1040-1865.
Bp 6565-6572 CMV Immediate early gene, partial Exon 2 taken from pGWIZ (Gene therapy systems), bp 1866-1873.
Bp 6573-6578 Restriction enzyme site, SalI
Bp 6579-6641 Conalbumin signal peptide, Corresponds to GenBank Accession Number Y00407 Bp 340-385, 1699-1715. Kozak sequence (Bp 6579-6584)
Bp 6642-6713 3xFlag. Synthetic sequence consisting of a purification tag and enterokinase cleavage site.
Bp 6714-7289 Human Growth hormone for chicken, using GeneBank Accession Number V00520, bp 140-715 (start codon and signal sequence omitted).
Bp 7290-7723 Poly A taken from vector pGWIZ (Gene Therapy Systems), bp 1900-2334.
Bp 7724-7729 Restriction enzyme site, XhoI
Bp 7730-11391 HS4 flanked MCS backbone vector BP 4929-8590
SEQ ID NO:28 (#217-11F TnPuro-MAR FBV(CMVpr-iA-hGH.CO-synPA)
Bp 1-5367 MAR Flanked Puromycin backbone vector.
Bp 5368-5373 Restriction enzyme site, XhoI
Bp 5374-5987 CMV enhancer taken from pGWIZ (Gene therapy systems), bp 230-843.
Bp 5988-6062 CMV promoter taken from pGWIZ (Gene therapy systems), bp 844-918.
Bp 6063-6183 CMV Immediate early gene, Exon 1 taken from pGWIZ (Gene therapy systems), bp 919-1039.
Bp 6184-7009 CMV intron A. Taken from pGWIZ (Gene therapy systems), bp 1040-1865.
Bp 7010-7017 CMV Immediate early gene, partial Exon 2 taken from pGWIZ (Gene therapy systems), bp 1866-1873.
Bp 7018-7023 Restriction enzyme site, SalI
Bp 7024-7086 Conalbumin signal peptide, Corresponds to GenBank accession Number Y00407, bp 340-385, 1699-1715. Kozak sequence (Bp 7024-7029)
Bp 7087-7158 3xFlag. Synthetic sequence consisting of a purification tag and enterokinase cleavage site.
Bp 7159-7734 Human Growth hormone for chicken, using GenBank Accession Number V00520, bp 140-715 (start codon and signal sequence omitted).
Bp 7735-8168 Poly A taken from vector pGWIZ (Gene Therapy Systems), bp 1900-2334.
Bp 8169-8174 Restriction enzyme site, XhoI
Bp 8175-13605 Mar flanked Puromycin backbone vector bp 5374-10804.
SEQ ID NO:29 (240 MAR FBV(synPA-hGH.CO-iA-CMVpr)
Bp 1-5367 MAR Flanked Puromycin backbone vector.
Bp 5368-5373 Restriction enzyme site, XhoI
Bp 5374-5807 Poly A taken from vector pGWIZ (Gene Therapy Systems), bp 2334-1900.
Bp 5808-6383 Human Growth hormone for chicken, using GenBank Accession Number V00520, bp 715-140 (start codon and signal sequence omitted).
Bp 6384-6455 3xFlag. Synthetic sequence consisting of a purification tag and enterokinase cleavage site.
Bp 6456-6518 Conalbumin signal peptide, Corresponds to GenBank accession Number Y00407, bp 1715-1699, 385-340. Kozak sequence (Bp 6513-6518)
Bp 6519-6524 Restriction enzyme site, SalI
Bp 6525-6532 CMV Immediate early gene, partial Exon 2 taken from pGWIZ (Gene therapy systems), bp 1873-1866.
Bp 6533-7358 CMV intron A. Taken from pGWIZ (Gene therapy systems), bp 1865-1040.
Bp 7359-7479 CMV Immediate early gene, Exon 1 taken from pGWIZ (Gene therapy systems), bp 1039-919.
Bp 7480-7554 CMV promoter taken from pGWIZ (Gene therapy systems), bp 918-844.
Bp 7555-8168 CMV enhancer taken from pGWIZ (Gene therapy systems), bp 843-230.
Bp 8169-8174 Restriction enzyme site, XhoI
Bp 8175-13605 MAR flanked Puromycin backbone vector bp 5374-10804.
SEQ ID NO:30
ID #133 and #159-Ovep-hGH-OVexpA—C1.10 cass in HS4 Flanked BV
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1785 Synthetic DNA added during construction (combination of two NruI RE sites)
Bp 1786-3021 Transposase modified from Tn10 GenBank Accession #J01829 Bp 81-1316
Bp 3022-3373 Non-coding DNA from vector pNK2859
Bp 3374-3416 Lambda DNA from pNK2859
Bp 3417-3486 70 bp of IS10 left from Tn10 (GenBank Accession #J01829 Bp 1-70)
Bp 3487-3490 Synthetic DNA added during construction
Bp 3491-3657 pBluescriptII sk(−) base vector (Stratagene, INC) bp 926-760
Bp 3658-3680 Multiple cloning site from pBluescriptII sk(−) thru NotI, Bp 759-737
Bp 3681-4922 Chicken HS4-Beta Globin enhancer element from gDNA (corresponds to Genbank Accession #NW_060254 bp 215169-216410)
Bp 4923-4936 Multiple Cloning Site Extension from pTnX-MCS, XhoI thru AscI
Bp 4937-5600 Chicken Ovalbumin Enhancer from gDNA (corresponds to Genbank Accession #AH003855 bp 13-675)
Bp 5601-6942 Chicken Ovalbummin Promoter from gDNA (corresponds to Genbank Accession #J00895 bp 1-1337)
Bp 6943-6948 XhoI RE site
Bp 6949-6964 pGWIZ base vector (Gene Therapy Systems) bp 903-918
Bp 6965-7085 CMV Immediate Early Gene, Exon 1 (vector pGWIZ, Gene Therapy Systems bp 919-1039)
BP 7086-7911 CMV Intron A (vector pGWIZ, Gene Therapy Systems bp 1040-1865)
Bp 7912-7919 CMV Immediate Early Gene, Partial Exon 2 (pGWIZ, Gene Therapy Systems) bp 1866-1873)

Bp 7920-7928 SalI RE site and Conalbumin Kozak sequence (Bp 7926-7931)
Bp 7929-7988 Conalbumin Signal Peptide (corresponds to Genbank Accession #Y00407 bp 343-385, 1699-1715)
Bp 7989-7994 Synthetic DNA added during construction (destroyed NgOMIV RE site)
Bp 7995-8045 3xFlag—no rotational spacer
Bp 8046-8060 Enterokinase cleavage site
Bp 8061-8636 Human Growth Hormone from V00520, bp 140-715 (start codon and ss omitted)
Bp 8637-8642 AatII RE site
Bp 8643-10533 Chicken Ovalbumin Extended PolyA from gDNA
Bp 10534-10598 MCS extension from pTN-MCS, PaI thru MluI
Bp 10599-11840 Chicken HS4-Beta Globin enhancer element from gDNA (corresponds to Genbank Accession #NW_060254 bp 215169-216410)
Bp 11841-11852 Synthetic DNA added during construction including a PspOMI RE site
Bp 11853-11922 70 bp of IS10 from Tn10 (GenBank Accession #J01829 Bp 70-1)
Bp 11923-11965 Lambda DNA from pNK2859
Bp 11966-11969 Synthetic DNA added during construction
Bp 11970-14170 pBluescriptII sk(−) base vector (Stratagene, INC) bp 761-2961

SEQ ID NO: 31 Vector #230-CMV-Ovalp Vs.1-hGH-CCG-OVexpA—in pTn-10 PURO-MAR Flanked BV
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3' end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Chicken Lysozyme Matrix Attachment region (MAR) from gDNA
Bp 5368-5381 Multiple Cloning Site Extension from pTn X-MCS, XhoI thru AscI
Bp 5382-6223 Chicken Ovalbumin promoter from gDNA (Genbank Accession #J00895 bp 421-1261)
BP 6224-6827 CMV Enhancer (vector pGWIZ, Gene Therapy Systems bp 245-843) with 5'EcoRI RE site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)
Bp 7861-7935 Conalbumin Signal Peptide (Genbank #Y00407) with 5'SalI RE site. Kozak sequence (Bp 7867-7872)
Bp 7936-7986 3xFlag—no rotational spacer
Bp 7987-8001 Enterokinase cleavage site
Bp 8002-8577 Human Growth Hormone-codon optimized (with CCG correction) GenBank #V00520 bp 140-715
Bp 8578-9515 Chicken Ovalbumin 3'Exon 7 and polyA (GenBank #J00895 bp 8260-9191) with 5'AatII RE site
Bp 9516-10484 Chicken Ovalbumin 3' terminus (GenBank #X01422 bp 288-1256)
Bp 10485-10531 MCS extension from pTN-MCS, PaI thru BsiWI
Bp 10532-10844 HSV-TK polyA from pS65TC1 bp 3873-3561
BP 10845-11475 Puromycin resistance gene from pMOD PURO (invivoGen)
Bp 11476-11867 SV40 promoter from pS65TC1, bp 2617-2232 with 5' MluI RE site
Bp 11868-13572 Chicken Lysozyme Matrix Attachment region (MAR) from gDNA
Bp 13573-13642 70 bp of IS10 from Tn10 (GenBank Accession #J01829 Bp 70-1)
Bp 13643-13685 Lambda DNA from pNK2859
Bp 13686-15890 pBluescriptII sk(−) base vector (Stratagene, INC)

SEQ ID NO:32 VECTOR #5021-235 pTn-10 PURO-MAR Flanked BV (CMV.Ovalp Vs.1cl.10-CCG OPA)
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3' end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC) bp 926-760
Bp 3652-3674 Multiple cloning site from pBluescriptII sk(−) thru NotI, Bp 759-737
Bp 3675-5367 Lysozyme Matrix Attachment Region (MAR)
Bp 5368-5376 Multiple Cloning Site Extension from pTn X-MCS, XhoI thru AscI
Bp 5377-6228 Chicken Ovalbumin Promoter GenBank accession (#J00895 and M24999)
Bp 6229-6827 CMV Enhancer (vector pGWIZ, Gene Therapy Systems bp 245-843)
Bp 6828-6905 CMV Promoter (vector pGWIZ, Gene Therapy Systems bp 844-918)

Bp 6906-7026 CMV Immediate Early Gene, Exon 1 (vector pGWIZ, Gene Therapy Systems bp 919-1039)
Bp 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)
Bp 7867-7929 Conalbumin Signal Sequence including Kozak sequence (Bp 7867-7872) (GenBank Accession #Y00407)
Bp 7936-7986 3xFlag without a Rotational Spacer (Sigma)
Bp 7987-8001 Enterokinase Cleavage Site
Bp 8002-8577 Codon Optimized human Growth Hormone (GenBank Accession # V00520 bp. 140-715)
Bp 8584-9499 Chicken Ovalbumin Regular length Poly A(Genbank accession # J00895 and X01422.)
Bp 9500-9546 Cloning Site Extension from pTn X-MCS, Pac I thru Bsi WI.
Bp 9547-9859 HSV-TK polyA from pS65TC1 bp 3873-3561
BP 9860-10490 Puromycin resistance gene from pMOD PURO (invivoGen)
Bp 10491-10876 SV40 promoter from pS65TC1, bp 2232-2617
Bp 10877-12587 Lysozyme Matrix Attachment Region (MAR)
Bp 12588-12657 70 bp of IS10 from Tn10 (GenBank Accession #J01829 Bp 70-1)
Bp 12658-12700 Lambda DNA from pNK2859
Bp 12701-14905 pBluescriptII sk(−) base vector (Stratagene, INC) bp 761-2961
SEQ ID NO: 33 Vector #284-5024 pTn-10 MAR Flanked BV (Hybrid Prom. Vs. 1/CMV ia/Con ss/3xF (−rs)/hGH-co/OPA)
Bp 1-132 Remainder of F1 (−) on of pBluescriptII sk(−) (Stratagene) bp 4-135
Bp 133-154 pGWIZ base vector (Gene Therapy Systems) bp 229-244
Bp 155-229 CMV promoter (from vector pGWIZ, Gene Therapy Systems bp 844-918)
Bp 230-350 CMV Immediate Early Gene, Exon 1 (vector pGWIZ, Gene Therapy Systems bp 919-1039)
Bp 351-1176 CMV Intron A (vector pGWIZ, Gene Therapy Systems bp 1040-1865)
Bp 1177-1184 CMV Immediate Early Gene, Partial Exon 2 (pGWIZ, Gene Therapy Systems) bp 1866-1873)
Bp 1185-1213 TN10 DNA, 3′ end from Genbank Accession #J01829 bp79-107
Bp 1214-2422 Transposon, modified from Tn10 GenBank Accession #J01829 bp 108-1316
Bp 2423-2774 Putative PolyA from vector pNK2859
Bp 2775-2817 Lambda DNA from pNK2859
Bp 2818-2887 70 bp of IS10 left from Tn10 (GenBank Accession #J01829 Bp 1-70)
Bp 2888-3058 pBluescriptII sk(−) base vector (Stratagene, INC)
Bp 3059-3081 Multiple cloning site from pBluescriptII sk(−) thru NotI, Bp 759-737
Bp 3082-4774 Chicken 5′ Lysozyme Matrix Attachment Region (MAR) from chicken gDNA corresponding to GenBank Accession #X98408
Bp 4775-4788 Multiple Cloning Site Extension from pTn X-MCS, XhoI thru Asc I
Bp 4789-5635 Chicken Ovalbumin Promoter GenBank accession (#J00895 and M24999)
Bp 5636-6234 CMV Enhancer (vector pGWIZ, Gene Therapy Systems bp 245-843)
Bp 6235-6312 CMV Promoter (vector pGWIZ, Gene Therapy Systems bp 844-918)

Bp 6313-6433 CMV Immediate Early Gene, Exon 1 (vector pGWIZ, Gene Therapy Systems bp 919-1039)
Bp 6434-7259 CMV Intron A (vector pGWIZ, Gene Therapy Systems bp 1040-1865)
Bp 7260-7273 CMV Immediate Early Gene, Partial Exon 2 and Sal I Restriction Enzyme site from pGWIZ Multiple cloning site.(pGWIZ, Gene Therapy Systems) bp1866-1879)
Bp 7274-7336 Conalbumin Signal Sequence including Kozak sequence (Bp 7274-7279) (GenBank Accession #Y00407)
Bp 7337-7393 3xFlag without a Rotational Spacer (Sigma)
Bp 7394-7408 Enterokinase Cleavage Site
Bp 7409-7984 Codon Optimized human Growth Hormone (GenBank Accession # V00520 bp. 140-715)
Bp 7985-8906 Chicken Ovalbumin Regular length Poly A(Genbank accession # J00895 and X01422.)
Bp 8907-8971 Multiple Cloning Site Extension from pTn X-MCS, PacI thru Mlu I
Bp 8972-10676 Chicken 3′ Lysozyme Matrix Attachment Region (MAR) from chicken gDNA corresponding to GenBank Accession #X98408
Bp 10677-10746 70 bp of IS10 from Tn10 (GenBank Accession #J01829 Bp 70-1)
Bp 10747-10789 Lambda DNA from pNK2859
Bp 10790-12994 pBluescriptII sk(−) base vector (Stratagene, INC)
SEQ ID NO: 34 Vector #285-5026
SV40 ATS MAR FBV (Hybrid Prom Vs. 1/CMV ia/Con ss/3xF/co-hGH/OPA
Bp 1-132 Remainder of F1 (−) on of pBluescriptII sk(−) (Stratagene) bp 4-135
Bp 133-154 pGWIZ base vector (Gene Therapy Systems) bp 229-244
Bp 155-539 SV40 promoter from pS65TC1 bp 2232-2617
Bp 541-661 CMV Immediate Early Gene, Exon 1 (vector pGWIZ, Gene Therapy Systems bp 919-1039)
Bp 662-1487 CMV Intron A (vector pGWIZ, Gene Therapy Systems bp 1040-1865)
Bp 1488-1495 CMV Immediate Early Gene, Partial Exon 2 (pGWIZ, Gene Therapy Systems) bp 1866-1873)
Bp 1496-1524 TN10 DNA, 3′ end from Genbank Accession #J01829 bp79-107
Bp 1525-2733 Transposon, modified from Tn10 GenBank Accession #J01829 bp 108-1316
Bp 2734-3085 Putative PolyA from vector pNK2859
Bp 3086-3128 Lambda DNA from pNK2859
Bp 3129-3198 70 bp of IS10 left from Tn10 (GenBank Accession #J01829 Bp 1-70)
Bp 3199-3369 pBluescriptII sk(−) base vector (Stratagene, INC)
Bp 3370-3392 Multiple cloning site from pBluescriptII sk(−) thru NotI, Bp 759-737
Bp 3393-5085 Chicken 5′ Lysozyme Matrix Attachment Region (MAR) from chicken gDNA corresponding to GenBank Accession #X98408
Bp 5086-5099 Multiple Cloning Site Extension from pTn X-MCS, XhoI thru AscI
Bp 5100-5946 Chicken Ovalbumin Promoter GenBank accession (#J00895 and M24999)
Bp 5947-6545 CMV Enhancer (vector pGWIZ, Gene Therapy Systems bp 245-843)
Bp 6546-6623 CMV Promoter (vector pGWIZ, Gene Therapy Systems bp 844-918)
Bp 6624-6744 CMV Immediate Early Gene, Exon 1 (vector pGWIZ, Gene Therapy Systems bp 919-1039)

Bp 6745-7570 CMV Intron A (vector pGWIZ, Gene Therapy Systems bp 1040-1865)
Bp 7571-7584 CMV Immediate Early Gene, Partial Exon 2 and Sal I Restriction Enzyme site from pGWIZ Multiple cloning site.(pGWIZ, Gene Therapy Systems) bp1866-1879)
Bp 7585-7647 Conalbumin Signal Sequence including Kozak sequence (Bp 7591-7596) (GenBank Accession #Y00407)
Bp 7648-7704 3xFlag without a Rotational Spacer (Sigma)
Bp 7705-7719 Enterokinase Cleavage Site
Bp 7720-8295 Codon Optimized human Growth Hormone (GenBank Accession #V00520 bp. 140-715)
Bp 8296-9217 Chicken Ovalbumin Regular length Poly A(Genbank accession # J00895 and X01422.)
Bp 9218-9282 Cloning Site Extension from pTn X-MCS, Pac I thru Bsi WI.
Bp 9283-10987 Chicken 3' Lysozyme Matrix Attachment Region (MAR) from chicken gDNA Corresponding to GenBank Accession #X98408
Bp 10988-11057 70 bp of IS10 from Tn10 (GenBank Accession #J01829 Bp 70-1)
Bp 11058-11100 Lambda DNA from pNK2859
Bp 11101-13305 pBluescriptII sk(−) base vector (Stratagene, INC)
SEQ ID NO:35 Vector #301-5025
pTn-10 (—CMV Enh.)PURO-MAR Flanked BV (CMV.Ovalp Vs.1cl.10-CCG OPA)
Bp 1-132 Remainder of F1 (−) on of pBluescriptII sk(−) (Stratagene) bp 4-135
Bp 133-154 pGWIZ base vector (Gene Therapy Systems) bp 229-244
Bp 155-229 CMV Promoter (vector pGWIZ, Gene Therapy Systems bp 844-918)
Bp 230-350 CMV Immediate Early Gene, Exon 1 (vector pGWIZ, Gene Therapy Systems bp 919-1039)
Bp 351-1176 CMV Intron A (vector pGWIZ, Gene Therapy Systems bp 1040-1865)
Bp 1177-1184 CMV Immediate Early Gene, Partial Exon 2 (pGWIZ, Gene Therapy Systems) bp 1866-1873)
Bp 1185-1213 TN10 DNA, 3' end from Genbank Accession #J01829 bp79-107
Bp 1214-2422 Transposon, modified from Tn10 GenBank Accession #J01829 Bp 108-1316
Bp 2423-2774 Putative PolyA from vector pNK2859
Bp 2775-2817 Lambda DNA from pNK2859
Bp 2818-2887 70 bp of IS10 left from Tn10 (GenBank Accession #J01829 Bp 1-70)
Bp 2888-3058 pBluescriptII sk(−) base vector (Stratagene, INC)
Bp 3059-3081 Multiple cloning site from pBluescriptII sk(−) thru NotI, Bp 759-737
Bp 3082-4774 Lysozyme Matrix Attachment Region (MAR) from chicken gDNA corresponding to GenBank Accession #X98408
Bp 4775-4788 Multiple Cloning Site Extension from pTn X-MCS, XhoI thru AscI
Bp 4789-5627 Chicken Ovalbumin Promoter GenBank accession (#J00895 and M24999)
Bp 5628-6234 CMV Enhancer (vector pGWIZ, Gene Therapy Systems bp 245-843)
Bp 6235-6312 CMV Promoter (vector pGWIZ, Gene Therapy Systems bp 844-918)
Bp 6313-6433 CMV Immediate Early Gene, Exon 1 (vector pGWIZ, Gene Therapy Systems bp 919-1039
Bp 6434-7259 CMV Intron A (vector pGWIZ, Gene Therapy Systems bp 1040-1865)
Bp 7260-7267 CMV Immediate Early Gene, Partial Exon 2 (pGWIZ, Gene Therapy Systems) bp 1866-1873)
Bp 7268-7336 Conalbumin Signal Sequence including Kozak sequence (Bp 7274-7279) (GenBank Accession #Y00407)
Bp 7337-7393 3xFlag without a Rotational Spacer (Sigma)
Bp 7394-7408 Enterokinase Cleavage Site
Bp 7409-7984 Codon Optimized human Growth Hormone (GenBank Accession #V00520 bp. 140-715)
Bp 7985-8906 Chicken Ovalbumin Regular length Poly A(Genbank accession # J00895 and X01422.)
Bp 8907-8953 Cloning Site Extension from pTn X-MCS, Pac I thru Bsi WI.
Bp 8954-9266 HSV-TK polyA from pS65TC1 bp 3873-3561
BP 9267-9897 Puromycin resistance gene from pMOD PURO (invivoGen)
Bp 9898-10283 SV40 promoter from pS65TC1, bp 2232-2617
Bp 10284-11982 Lysozyme Matrix Attachment Region (MAR)
Bp 11983-12064 70 bp of IS10 from Tn10 (GenBank Accession #J01829 Bp 70-1)
Bp 12065-12111 Lambda DNA from pNK2859
Bp 12112-14312 pBluescriptII sk(−) base vector (Stratagene, INC) bp 761-2961
SEQ ID NO:36 #302-5027 pTN-10 SV 40 Pr.PURO-MAR Flanked BV (CMV.Ovalp Vs.1cl.10-CCG OPA)
Bp 1-132 Remainder of F1 (−) on of pBluescriptII sk(−) (Stratagene) bp 4-135
Bp 133-154 pGWIZ base vector (Gene Therapy Systems) bp 229-244
Bp 155-540 SV40 Promoter from pS65TC1, Bp 2232-2617
Bp 541-661 CMV Immediate Early Gene, Exon 1 (vector pGWIZ, Gene Therapy Systems bp 919-1039)
Bp 662-1487 CMV Intron A (vector pGWIZ, Gene Therapy Systems bp 1040-1865)
Bp 1488-1495 CMV Immediate Early Gene, Partial Exon 2 (pGWIZ, Gene Therapy Systems) bp 1866-1873)
Bp 1496-1524 TN10 DNA, 3' end from Genbank Accession #J01829 bp79-107
Bp 1525-2733 Transposon, modified from Tn10 GenBank Accession #J01829 Bp 108-1316
Bp 2734-3085 Putative PolyA from vector pNK2859
Bp 3086-3128 Lambda DNA from pNK2859
Bp 3129-3198 70 bp of IS10 left from Tn10 (GenBank Accession #J01829 Bp 1-70)
Bp 3299-3369 pBluescriptII sk(−) base vector (Stratagene, INC)
Bp 3370-3392 Multiple cloning site from pBluescriptII sk(−) thru NotI, Bp 759-737
Bp 3393-5085 Lysozyme Matrix Attachment Region (MAR) from chicken gDNA (GenBank Accession #X98408.
Bp 5086-5099 Multiple Cloning Site Extension from pTn X-MCS, XhoI thru AscI
Bp 5100-5946 Chicken Ovalbumin Promoter GenBank accession (#J00895 and M24999)
Bp 5947-6545 CMV Enhancer (vector pGWIZ, Gene Therapy Systems bp 245-843)
Bp 6546-6623 CMV Promoter (vector pGWIZ, Gene Therapy Systems bp 844-918)
Bp 6624-6744 CMV Immediate Early Gene, Exon 1 (vector pGWIZ, Gene Therapy Systems bp 919-1039
Bp 6745-7570 CMV Intron A (vector pGWIZ, Gene Therapy Systems bp 1040-1865)
Bp 7571-7584 CMV Immediate Early Gene, Partial Exon 2 Sal I Restriction Enzymesite from pGWIZ Multiple cloning site (pGWIZ, Gene Therapy Systems) bp1866-1879)

Bp 7585-7647 Conalbumin Signal Sequence including Kozak (7585-7590)(GenBank Accession #Y00407)
Bp 7648-7704 3xFlag without a Rotational Spacer (Sigma)
Bp 7705-7719 Enterokinase Cleavage Site
Bp 7720-8295 Codon Optimized human Growth Hormone (GenBank Accession # V00520 bp. 140-715)
Bp 8296-9217 Chicken Ovalbumin Regular length Poly A(Genbank accession # J00895 and X01422.)
Bp 9218-9264 Cloning Site Extension from pTn X-MCS, Pac I thru Bsi WI.
Bp 9265-9577 HSV-TK polyA from pS65TC1 bp 3873-3561
BP 9678-10208 Puromycin resistance gene from pMOD PURO (invivoGen)
Bp 10209-10600 SV40 promoter from pS65TC1, bp 2232-2617
Bp 10601-12305 Lysozyme Matrix Attachment Region (MAR)
Bp 12306-12375 70 bp of IS10 from Tn10 (GenBank Accession #J01829 Bp 70-1)
Bp 12376-12418 Lambda DNA from pNK2859
Bp 12419-14623 pBluescriptII sk(−) base vector (Stratagene, INC) bp 761-2961
SEQ ID NO: 37 Vector ID #283—HPvs1/CMViA/CAss/cohGH(mat/OPA in pTn-10 PURO-MAR Flanked BV
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3' end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Chicken Lysozyme Matrix Attachment region (MAR) from gDNA
Bp 5368-5381 Multiple Cloning Site Extension from pTn X-MCS, XhoI thru AscI
Bp 5382-6223 Chicken Ovalbumin promoter from gDNA (Genbank Accession #J00895 bp 421-1261)
BP 6224-6827 CMV Enhancer (vector pGWIZ, Gene Therapy Systems bp 245-843) with 5'EcoRI RE site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)

Bp 7861-7929 Conalbumin Signal Peptide (Genbank #Y00407 bp 340-385, 1699-1715) with 5'SalI RE site. Kozak sequence (Bp 7867-7872)
Bp 7930-8511 Human Growth Hormone-codon optimized (GenBank #V00520 bp 140-715) with 5'AfeI RE site
Bp 8512-9433 Chicken Ovalbumin polyA from gDNA (GenBank #J00895 bp 8260-9175) with 5'AatII RE site
Bp 9434-9480 MCS extension from pTN-MCS, PacI thru BsiWI
Bp 9481-9793 HSV-TK polyA from pS65TC1 bp 3873-3561
BP 9794-10424 Puromycin resistance gene from pMOD PURO (invivoGen)
Bp 10425-10816 SV40 promoter from pS65TC1, bp 2617-2232 with 5' MluI RE site
Bp 10817-12521 Chicken Lysozyme Matrix Attachment region (MAR) from gDNA
Bp 12522-12591 70 bp of IS10 from Tn10 (GenBank Accession #J01829 Bp 70-1)
Bp 12592-12634 Lambda DNA from pNK2859
Bp 12635-14839 pBluescriptII sk(−) base vector (Stratagene, INC)
SEQ ID NO: 38 Vector ID #268—HPvs1/CMViA/CAss(-3aa)/cohGH(mat/OPA in pTn-10 PURO-MAR Flanked BV
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3' end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Chicken Lysozyme Matrix Attachment region (MAR) from gDNA
Bp 5368-5381 Multiple Cloning Site Extension from pTn X-MCS, XhoI thru AscI
Bp 5382-6223 Chicken Ovalbumin promoter from gDNA (Genbank Accession #J00895 bp 421-1261)
BP 6224-6827 CMV Enhancer (vector pGWIZ, Gene Therapy Systems bp 245-843) with 5'EcoRI RE site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)

Bp 7861-7926 Conalbumin Signal Peptide (Genbank #Y00407 bp 340-385, 1699-1712) with 5'SalI RE site. Kozak sequence (Bp 7867-7872)
Bp 7927-8502 Human Growth Hormone-codon optimized (GenBank Accession #V00520 bp 140-715)
Bp 8503-9424 Chicken Ovalbumin polyA from gDNA (GenBank #J00895 bp 8260-9175) with 5'AatII RE site
Bp 9425-9471 MCS extension from pTN-MCS, Pad thru BsiWI
Bp 9472-9784 HSV-TK polyA from pS65TC1 bp 3873-3561
BP 9785-10415 Puromycin resistance gene from pMOD PURO (invivoGen)
Bp 10416-10807 SV40 promoter from pS65TC1, bp 2617-2232 with 5' MluI RE site
Bp 10808-12512 Chicken Lysozyme Matrix Attachment region (MAR) from gDNA
Bp 12513-12582 70 bp of IS10 from Tn10 (GenBank Accession #J01829 Bp 70-1)
Bp 12583-12629 Lambda DNA from pNK2859
Bp 12630-14830 pBluescriptII sk(−) base vector (Stratagene, INC) bp 761-2961
SEQ ID NO:39 Vector ID #312 —HPvs1/CMViA/CAss(−2aa)3Xent/cohGH(mat/OPA in pTn-10 PURO-MAR Flanked BV
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3' end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Chicken Lysozyme Matrix Attachment region (MAR) from gDNA
Bp 5368-5381 Multiple Cloning Site Extension from pTn X-MCS, XhoI thru AscI
Bp 5382-6222 Chicken Ovalbumin promoter from gDNA (Genbank Accession #J00895 bp 421-1261)
BP 6223-6827 CMV Enhancer (vector pGWIZ, Gene Therapy Systems bp 245-843) with 5'EcoRI RE site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)

Bp 7861-7929 Conalbumin Signal Peptide (Genbank #Y00407 bp 340-385, 1699-1715) with 5'SalI RE site. Kozak sequence (Bp 7867-7872)
Bp 7930-7980 3xFlag
Bp 7981-7995 Enterokinase Cleavage Site
Bp 7996-8571 Human Growth Hormone-codon optimized (GenBank #V00520 bp 140-715) with 5'AfeI RE site
Bp 8572-9493 Chicken Ovalbumin polyA from gDNA (GenBank #J00895 bp 8260-9175) with 5'AatII RE site
Bp 9494-9523 MCS extension from pTN-MCS, Pad thru BsiWI
Bp 9524-9836 HSV-TK polyA from pS65TC1 bp 3873-3561
BP 9837-10467 Puromycin resistance gene from pMOD PURO (invivoGen)
Bp 10468-10853 SV40 promoter from pS65TC1, bp 2617-2232 with 5' MluI RE site
Bp 10854-12564 Chicken Lysozyme Matrix Attachment region (MAR) from gDNA
Bp 12565-12634 70 bp of IS10 from Tn10 (GenBank Accession #J01829 Bp 70-1)
Bp 12635-12677 Lambda DNA from pNK2859
Bp 12678-14882 pBluescriptII sk(−) base vector (Stratagene, INC)

In one embodiment, the present application provides a novel sequence comprising a promoter, a gene of interest, and a poly A sequence. Each of these novel sequences may be identified from the annotations for each expression vector shown above, and also as sequences within the sequence listing for each expression vector. The specific bases of these novel sequences are provided in Table 3 below for each expression vector SEQ ID NOs: 17 to 39.

TABLE 3

| hGH Vectors | | |
|---|---|---|
| SEQ ID NO | Begin | End |
| 17 x | 4937 | 10038 |
| 18 x | 4937 | 9660 |
| 19 x | 4937 | 10044 |
| 20 x | 4932 | 12362 |
| 21 x | 4925 | 12356 |
| 22 sh | 4925 | 11387 |
| 23 x | 4937 | 10533 |
| 24 x | 4931 | 10527 |
| 25 x | 4623 | 10219 |
| 26 x | 5382 | 10978 |
| 27 sy | 4929 | 7723 |
| 28 sy | 5374 | 8168 |
| 29 sy | 5374 | 8168 |
| 30 x | 4937 | 10533 |
| 31 x | 5382 | 10484 |
| 32 sh | 5377 | 9499 |
| 33 sh | 4789 | 8906 |
| 34 sh | 5100 | 9217 |
| 35 sh | 4789 | 8906 |
| 36 sh | 5100 | 9217 |
| 37 sh | 5382 | 9433 |
| 38 sh | 5382 | 9424 |
| 39 sh | 5382 | 9493 | x indicates extended ovalbumin polyA.
sh indicates short ovalbumin polyA.
sy indicates synthetic ovalbumin polyA.

E. Methods of In Vivo Administration

The polynucleotide cassettes may be delivered through the vascular system to be distributed to the cells supplied by that vessel. For example, the compositions may be administered through the cardiovascular system to reach target tissues and cells receiving blood supply. In one embodiment, the compositions may be administered through any chamber of the heart, including the right ventricle, the left ventricle, the right atrium or the left atrium. Administration into the right side of the heart may target the pulmonary circulation and tissues supplied by the pulmonary artery. Administration into the left side of the heart may target the systemic circulation through the aorta and any of its branches, including but not limited to the coronary vessels, the ovarian or testicular arteries, the renal arteries, the arteries supplying the gastrointestinal and pelvic tissues, including the celiac, cranial mesenteric and caudal mesenteric vessels and their branches, the common iliac arteries and their branches to the pelvic organs, the gastrointestinal system and the lower extremity, the carotid, brachiocephalic and subclavian arteries. It is to be understood that the specific names of blood vessels change with the species under consideration and are known to one of ordinary skill in the art. Administration into the left ventricle or ascending or descending aorta supplies any of the tissues receiving blood supply from the aorta and its branches, including but not limited to the testes, ovary, oviduct, and liver. Germline cells and other cells may be transfected in this manner. For example, the compositions may be placed in the left ventricle, the aorta or directly into an artery supplying the ovary or supplying the fallopian tube to transfect cells in those tissues. In this manner, follicles could be transfected to create a germline transgenic animal. Alternatively, supplying the compositions through the artery leading to the oviduct would preferably transfect the tubular gland and epithelial cells. Such transfected cells could manufacture a desired protein or peptide for deposition in the egg white. Administration of the compositions through the left cardiac ventricle, the portal vein or hepatic artery would target uptake and transformation of hepatic cells. Administration may occur through any means, for example by injection into the left ventricle, or by administration through a cannula or needle introduced into the left atrium, left ventricle, aorta or a branch thereof.

Intravascular administration further includes administration in to any vein, including but not limited to veins in the systemic circulation and veins in the hepatic portal circulation. Intravascular administration further includes administration into the cerebrovascular system, including the carotid arteries, the vertebral arteries and branches thereof.

Intravascular administration may be coupled with methods known to influence the permeability of vascular barriers such as the blood brain barrier and the blood testes barrier, in order to enhance transfection of cells that are difficult to affect through vascular administration. Such methods are known to one of ordinary skill in the art and include use of hyperosmotic agents, mannitol, hypothermia, nitric oxide, alkylglycerols, lipopolysaccharides (Haluska et al., Clin. J. Oncol. Nursing 8(3): 263-267, 2004; Brown et al., Brain Res., 1014: 221-227, 2004; Ikeda et al., Acta Neurochir. Suppl. 86:559-563, 2004; Weyerbrock et al., J. Neurosurg. 99(4):728-737, 2003; Erdlenbruch et al., Br. J. Pharmacol. 139(4):685-694, 2003; Gaillard et al., Microvasc. Res. 65(1):24-31, 2003; Lee et al., Biol. Reprod. 70(2):267-276, 2004)).

Intravascular administration may also be coupled with methods known to influence vascular diameter, such as use of beta blockers, nitric oxide generators, prostaglandins and other reagents that increase vascular diameter and blood flow.

Administration through the urethra and into the bladder would target the transitional epithelium of the bladder. Administration through the vagina and cervix would target the lining of the uterus and the epithelial cells of the fallopian tube.

The polynucleotide cassettes may be administered in a single administration, multiple administrations, continuously, or intermittently. The polynucleotide cassettes may be administered by injection, via a catheter, an osmotic mini-pump or any other method. In some embodiments, a polynucleotide cassette is administered to an animal in multiple administrations, each administration containing the polynucleotide cassette and a different transfecting reagent.

In a preferred embodiment, the animal is an egg-laying animal, and more preferably, an avian, and the transposon-based vectors comprising the polynucleotide cassettes are administered into the vascular system, preferably into the heart. The vector may be injected into the venous system in locations such as the jugular vein and the metatarsal vein. In one embodiment, between approximately 1 and 1000 µg, 1 and 200 µg, 5 and 200 µg, or 5 and 150 µg of a transposon-based vector containing the polynucleotide cassette is administered to the vascular system, preferably into the heart. In a chicken, it is preferred that between approximately 1 and 300 µg, or 5 and 200 µg are administered to the vascular system, preferably into the heart, more preferably into the left ventricle. The total injection volume for administration into the left ventricle of a chicken may range from about 10 µl to about 5.0 ml, or from about 100 µl to about 1.5 ml, or from about 200 µl to about 1.0 ml, or from about 200 µl to about 800 µl. It is to be understood that the total injection volume may vary depending on the duration of the injection. Longer injection durations may accommodate higher total volumes. In a quail, it is preferred that between approximately 1 and 200 µg, or between approximately 5 and 200 µg are administered to the vascular system, preferably into the heart, more preferably into the left ventricle. The total injection volume for administration into the left ventricle of a quail may range from about 10 µl to about 1.0 ml, or from about 100 µl to about 800 µl, or from about 200 µl to about 600 µl. It is to be understood that the total injection volume may vary depending on the duration of the injection. Longer injection durations may accommodate higher total volumes. The microgram quantities represent the total amount of the vector with the transfection reagent.

In another embodiment, the animal is an egg-laying animal, and more preferably, an avian. In one embodiment, between approximately 1 and 150 µg, 1 and 100 µg, 1 and 50 µg, preferably between 1 and 20 µg, and more preferably between 5 and 10 µg of a transposon-based vector containing the polynucleotide cassette is administered to the oviduct of a bird. In a chicken, it is preferred that between approximately 1 and 100 µg, or 5 and 50 µg are administered. In a quail, it is preferred that between approximately 5 and 10 µg are administered. Optimal ranges depending upon the type of bird and the bird's stage of sexual maturity. Intraoviduct administration of the transposon-based vectors of the present invention result in a PCR positive signal in the oviduct tissue, whereas intravascular administration results in a PCR positive signal in the liver, ovary and other tissues. In other embodiments, the polynucleotide cassettes is administered to the cardiovascular system, for example the left cardiac ventricle, or directly into an artery that supplies the oviduct or the liver. These methods of administration may also be combined with any methods for facilitating transfection, including without limitation, electroporation, gene guns, injection of naked DNA, and use of dimethyl sulfoxide (DMSO). U.S. Pat. No. 7,527,966, U.S. Publication No. 2008/0235815, and PCT Publication No. WO 2005/062881 are hereby incorporated by reference in their entirety.

The following examples will serve to further illustrate the present invention without, at the same time, however, constituting any limitation thereof. On the contrary, it is to be clearly understood that resort may be had to various embodiments, modifications and equivalents thereof which, after reading the description herein, may suggest themselves to those skilled in the art without departing from the spirit of the invention.

EXAMPLE 1

Experiments to Compare Vectors Containing Hybrid Promoters

These experiments were conducted to determine if the vectors were functioning. No attempt was made to select or clone these cells for long term expression. In the first two experiments, the first objective of each experiment was to determine whether the new promoters would function in tubular gland and LMH2A cells, respectively. A second objective of the second experiment was to determine if the promoters were estrogen responsive. Estrogen responsiveness could not be tested in tubular gland cells (first experiment) because estrogen cannot be removed from these cells long enough for them to return to a basal level. If this is done in culture, the cells lose their ability to respond to estrogen. The results from this experiment showed that all of the hybrid promoters (SEQ ID NOs:14 and 15, and base pairs 4937 to 6465 of SEQ ID NO:19) inserted into backbone vectors SEQ ID NOs:17, 18, and 19, respectively, functioned in tubular gland cells with versions SEQ ID NOs:17 and 18 expressing the most protein in vitro. In the second experiment, LMH2A cells were transfected with each of the hybrid promoter vectors SEQ ID NOs:17, 18, and 19. Duplicate flasks were set up for each vector so expression in the absence and presence of estrogen could be determined. The most pronounced effect in estrogen responsiveness was seen in the M3 ($3^{rd}$ media sample) taken 6 days after transfection.

The results are summarized below:
1) Each of the hybrid promoters (SEQ ID NOs:14 and 15, and base pairs 4937 to 6465 of SEQ ID NO:19) inserted into backbone vectors SEQ ID NOs:17, 18, and 19, respectively, worked in tubular gland cells and LMH2A cells;
2) SEQ ID NOs:17 and 18 containing hybrid promoters SEQ ID NOs:14 and 15 (versions 1 and 2, respectively) expressed best in both cell types;
3) In LMH2A cells, all 3 promoters appeared to be estrogen responsive; and,
4) Addition of the ovalbumin estrogen responsive elements did not confer tissue specificity in vitro.

The third experiment was conducted in LMH2A cells in order to compare the hybrid promoters to the original CMV promoter and estimate the amount of protein being expressed. Again, no attempt was made to select or clone these cells for long term expression, only transient expression was examined. The results differed from our normal expression pattern. Normally, the M2 and M3 media samples gave the highest rate of expression, but in this experiment, M1 was highest. This was not due to the hybrid promoters since the original CMV promoter was included in this experiment and produced the same expression pattern. Regardless, the hybrid promoter version 1 and 2 (SEQ ID NOs:14 and 15 in backbone vectors SEQ ID NOs:17 and 18, respectively), expressed protein at a rate nearly double that of the original CMV promoter in M1 media and three times that of the CMV promoter in M2 media. The original CMV promoter outperformed hybrid promoter version 3 almost 3:1 in M1 media and about 5:1 in M2 media.

EXAMPLE 2

Transfection of LMH2A and Chicken Tubular Gland Cells with CMV/Oval$_p$-3×F-hGH

Experiments were conducted to test three vectors, SEQ ID NOs:17, 18, and 19, containing different versions of the hybrid CMV/Oval promoter (SEQ ID NOs:14, 15, and bp 4937-6465 of SEQ ID NO:19, respectively) with the 3xFlag hGH cassette (OVep/CMV intron A/Con SS/3xFlag/hGH/OV ext PA). Chicken tubular gland (ChTG) cells were tested in the first experiment, and LMH2A cells were used for the second experiment. Our standard protocol for each cell type was followed. The transfection scheme is shown below.

TABLE 4

| 1121 Flask ChTG | 1122 Flask LMH2A | Vector | SEQ ID NO: | Promoter | SEQ ID NO: |
|---|---|---|---|---|---|
| C1 | C1 & C2 | N/A | — | N/A | — |
| T1 | T1 & T2 | 153 | 17 | Vs. 1 | 14 |
| T2 | T3 & T4 | 173 | 18 | Vs. 2 | 17 |
| T3 | T5 & T6 | 174 | 19 | Vs. 3 | bp 4937-6465 of SEQ ID NO: 19 |

The tubular gland cells were fed with media containing 1× estrogen, insulin and corticosterone prior to transfection (standard protocol). Stock solutions of these supplements are made at 1000×. 1× in media gives the final concentrations: Beta-estradiol: 200 µM; corticosterone: 10 µM; and, insulin: 50 ng/ml. These are the concentrations used for tubular gland cells. When LMH2A cells are stimulated with estrogen, 50× B-estradiol was used and 1× insulin, but no corticosterone. Media was collected 3 days (M1) and 6 days (M2) post transfection. Cells were harvested on the sixth day.

In the LMH2A cells, standard Waymouth's+10% fetal calf serum (FCS) was used for transfection. After 24 hours, media was collected (M1), and C1, T1, T3 and T5 were fed with Waymouth's+5% FCS. C2, T2, T4 and T6 were fed the same plus 50× estrogen/1× insulin. This was done to determine if the steroids affected promoter activity. Media was collected again at 3 (M2) and 6 (M3) days post transfection. Cells were harvested on day 6.

Figure 3:
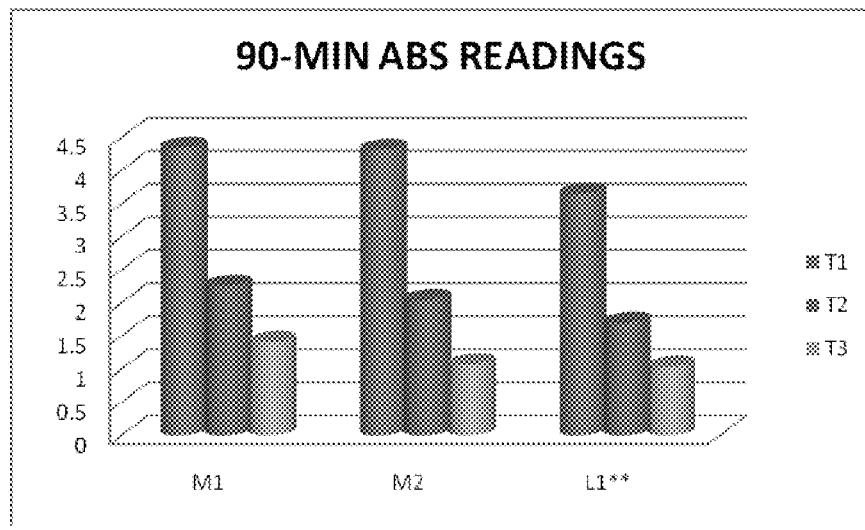
FIG. 3 presents GH ELISA results. T1, T2, and T3 are displayed in order from left to right at each of M1, M2, and L1.

FIG. 3 shows the GH ELISA results for the chicken tubular gland cells with the three versions of the hybrid promoter. Clearly, Version 1 (T1 (SEQ ID NO: 17)) of the promoter gives consistently higher readings in these cells under these conditions, followed by Version 2 (T2 (SEQ ID NO:18)), with Version 3 (T3 (SEQ ID NO:19) giving the lowest readings. The L1** samples were run on a different plate than the rest of the samples, and a positive control run on both plates gave slightly lower readings on the plate with the lysate samples. Accordingly, it was not possible to compare absolute values between the lysates and the media samples. Also note that 90-minute readings were used for these comparisons, because later readings 'maxed out' the reader. No attempt was made to quantitate the protein content of these samples.

Figure 4:
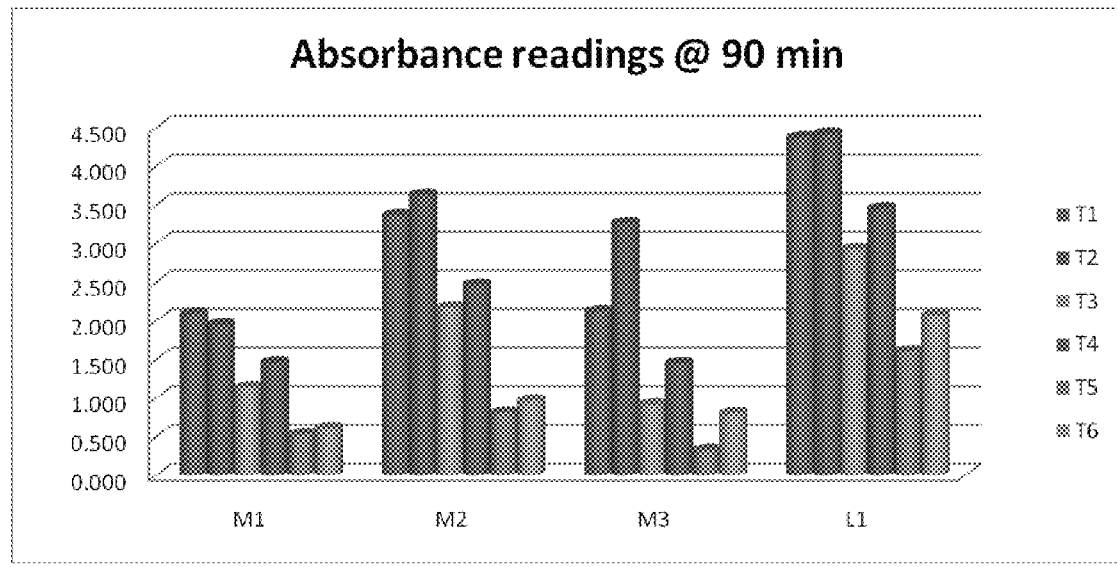
FIG. 4 presents GH ELISA results (absorbance readings). T1, T2, T3, T4, T5, and T6 are displayed in order from left to right at each of M1, M2, M3, and L1.

FIG. 4 shows the 90-minute ELISA readings from Expt. 1122, done in LMH2A cells. Note that these readings were done on 1:500 dilutions of the original samples. T1, T3, and T5 are Versions 1, 2, and 3 (SEQ ID NOs:14, 15, and base pairs 4937-6465 of SEQ ID NO:19) in the vectors shown as SEQ ID NOs:17, 18, and 19, respectively, without estrogen. T2, T4, and T6 are the same, with estrogen. Therefore, when looking at the graphs in FIG. 4, each pair of bars represents a single promoter version, with the first bar being that version without estrogen, and the second bar representing the sample run with estrogen. For each of M1, M2, M3, and L1 in the next two figures, the T1 through T6 results are shown in order from left to right. As in the tubular gland cells, SEQ ID NO:17 gives the highest readings, followed by SEQ ID NO:18, with SEQ ID NO:19 giving the lowest readings. This experiment, however, was also designed to examine the estrogen-responsiveness of these hybrid promoters in LMH2A cells. It does appear that all 3 promoters were responsive to estrogen in these cells, with the most statistically significant differences at the M3 time point in which all samples were statistically different from each other except for T3 and T6 (p<0.05).

Figure 5:
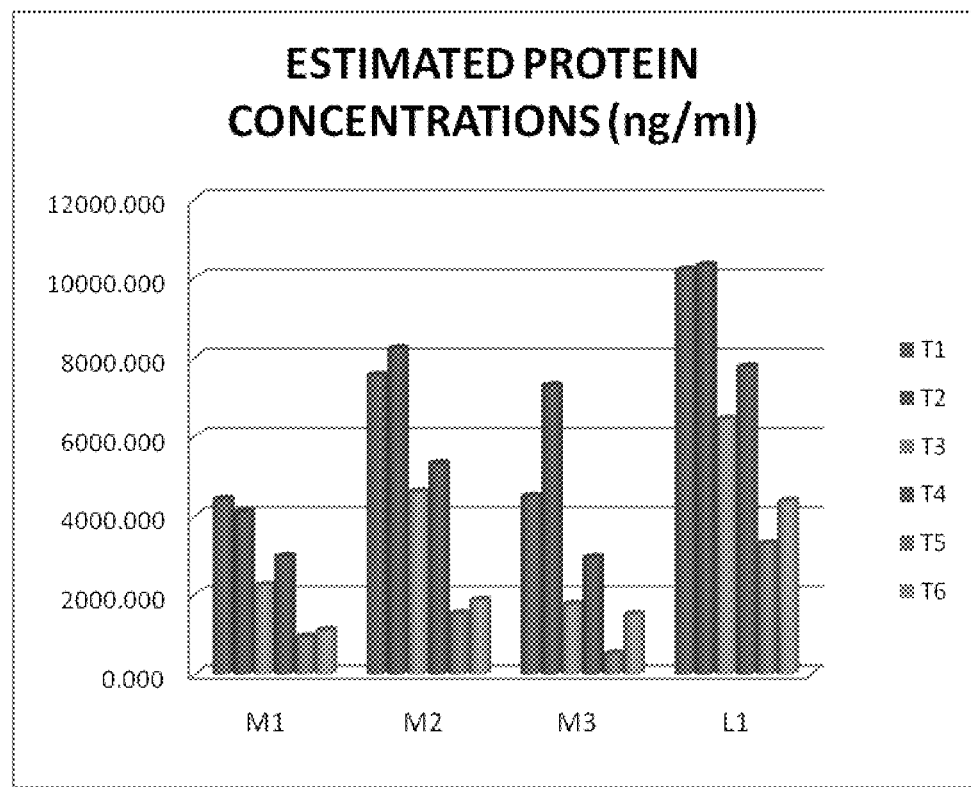
FIG. 5 presents estimated protein concentration results. T1, T2, T3, T4, T5, and T6 are displayed in order from left to right at each of M1, M2, M3, and M4.

FIG. 5 shows the estimated protein concentrations, calculated from the 90-minute readings, for each sample shown above. There were essentially no differences between this graph and the one above. Clearly, in both cell types, the vector containing Version 1 (SEQ ID NO:17) produced the most GH, followed by the vector containing Version 2 (SEQ ID NO:18) and then by the vector containing Version 3 (SEQ ID NO:19). All 3 appeared to be estrogen responsive, at least in LMH2A cells, and the differences became more pronounced with time. All 3 of these constructs use the CMV core promoter.

The hybrid promoters were prepared independently and then cloned upstream of the CMV intron A. (SEQ ID NO:14) Version 1, the highest producer, had the CMV enhancer directly preceding the promoter, in its 'normal' position, and this combination appeared to give the highest production. A portion of the OVAL 5' upstream region containing sequences identified as the steroid dependent response element (SDRE) and negative response element (NRE) preceded the CMVenh promoter, and seemed to confer steroid responsiveness on the CMVpr in LMH2A cells. SEQ ID NO:15 Version 2 was almost the same structure, except that the NRE was moved to a position between the CMV enhancer and promoter. This significantly reduced total production. (Base pairs 4937-6465 of SEQ ID NO:19) Version 3 placed the entire Ch OVAL SDRE through NRE sequence between the CMV enhancer and promoter, further reducing overall protein production by the promoter.

EXAMPLE 3

Hybrid-hGH Vectors in LMH2A Cells

This experiment was conducted to test three vectors (SEQ ID NOs:17, 18, and 19) with different versions of the CMV/Oval hybrid promoter. All vectors were based on the hGH gene from vector 171 (SEQ ID NO:27). LMH2A cells were seeded to 5 T25s flasks (25 cm²) the day prior to transfection. One flask was used for control, and the other four were transfected using 2 μg DNA and Fugene 6 (DNA:Fugene=1:6) following our standard protocol:
T1: 171 (SEQ ID NO:27)
T2: 153 (hybrid promoter v1) (SEQ ID NO:17)
T3: 173 (hybrid promoter v2) (SEQ ID NO:18)
T3: 174 (hybrid promoter v3) (SEQ ID NO:19)
Media was collected and the cells were fed every 2-3 days.

Figure 6:
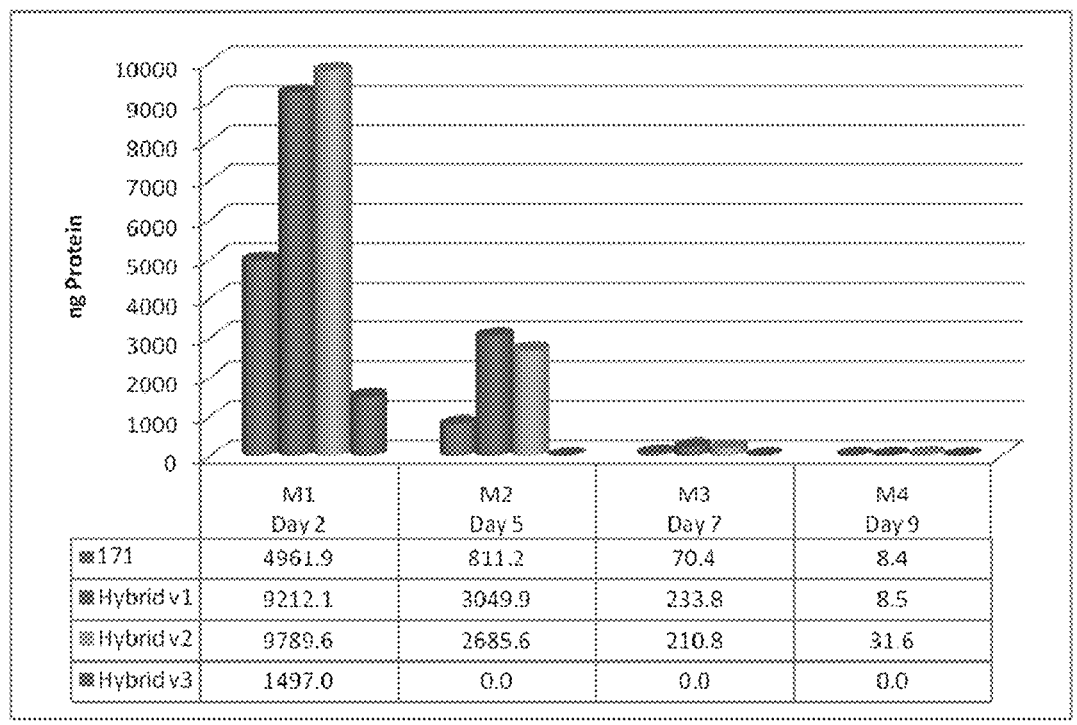
FIG. 6 presents GH ELISA results. 171 (SEQ ID NO:27), Hybrid v1, Hybrid v2, and Hybrid v3 are displayed in order from left to right at each of M1, M2, M3, and M4. See

FIG. 6 illustrates the protein quantification (ng/well) from the ELISA results. The M1 and M2 samples were diluted 1:5000, and the M3 and M4 samples were diluted 1:500 for the ELISA assay.

The M1 and M2 samples were also tested at the same 1:5000 dilutions and some varied by as much as 35%. The comparison of these readings is shown in Table 5 below. In addition, many of the M3 and M4 samples were below the standard curve. Based on an earlier result, both vectors SEQ ID NO:17 and 18 containing versions 1 and 2 of the hybrid promoter were better than SEQ ID NO:27 in the first two media samples.

TABLE 5

| 1st ELISA | ng/ml | 2nd ELISA | ng/ml | % Difference |
|---|---|---|---|---|
| T1.M1 1:5000 | 4961.9 | T1.M1 1:5000 | 5030.7 | 1.39% |
| T2.M1 1:5000 | 9212.1 | T2.M1 1:5000 | 9102.9 | −1.18% |

TABLE 5-continued

| 1st ELISA | ng/ml | 2nd ELISA | ng/ml | % Difference |
|---|---|---|---|---|
| T3.M1 1:5000 | 9789.6 | T3.M1 1:5000 | 11150.4 | 13.90% |
| T4.M1 1:5000 | 1497.0 | T4.M1 1:5000 | 1788.9 | 19.50% |
| T1.M2 1:5000 | 811.2 | T1.M2 1:5000 | 1095.9 | 35.09% |
| T2.M2 1:5000 | 3049.9 | T2.M2 1:5000 | 3005.2 | −1.47% |
| T3.M2 1:5000 | 2685.6 | T3.M2 1:5000 | 2867.8 | 6.79% |
| T4.M2 1:5000 | 0.0 | T4.M2 1:5000 | 274.6 | ? |

EXAMPLE 4

New hGH Vectors

This experiment was designed to test several new vectors in cell culture. These are variations on Series A containing the ovalbumin promoter and intron or Series B containing the ovalbumin promoter and the CMV intron A.

Series A Vectors (FIG. 7) included the following:
T1: The original (Ovenh prom/Ov Ver 5(OVg+0 ia)/nrs 3xF/co hGH/OV XLpA) in the HS4 flanked backbone vector. (#157) (SEQ ID NO:20)
T2: Same cassette, but in the pTn10HFB backbone vector. (#181) (SEQ ID NO:21)
T3: Same as T2, but with the original, shorter OVpA. (#170) (SEQ ID NO:22)

Figure 7:
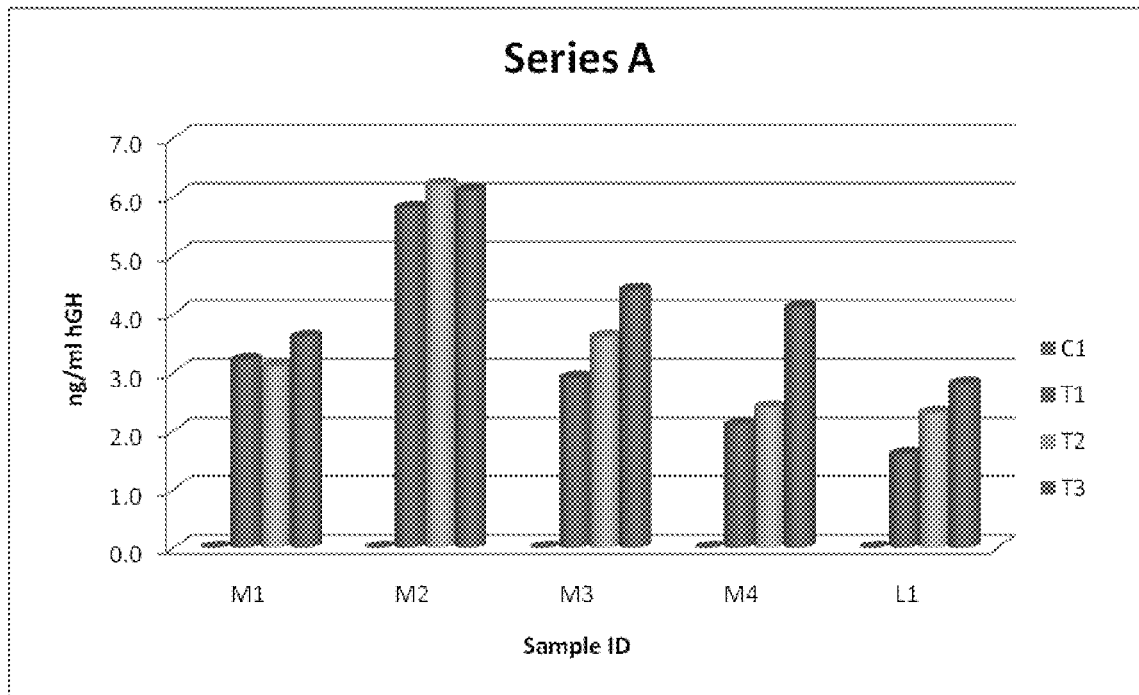
FIG. 7 presents GH ELISA results for Experiment 1136. C1, T1, T2, and T3 are displayed in order from left to right at each of M1, M2, M3, M4, and L1.

Note that although there was little difference between these vectors in the early samples, by the M3, and especially the M4 samples, the T3 (shorter polyA) vector (SEQ ID NO:22) gave significantly higher protein readings, suggesting that it was maintaining higher levels of protein production longer than the others (FIG. 7).

Series B Vectors (FIG. 8) included the following:
T4: The original (OVep/CMV IA/CONss/(−rs)3xFlag/hGH/OV XLpA) in the HS4-flanked backbone vector (#159) (SEQ ID NO:23)
T5: Same cassette, but in the pTn10 HS4-flanked backbone vector (#202) (SEQ ID NO:24)
T6: Same cassette, but in the LysRep Ver 2 backbone vector (#203) (SEQ ID NO:25)
T7: Same cassette, but in the MAR-flanked backbone vector (#204) (SEQ ID NO:26)
T8: The original in the HS4-flanked BV (VID #171) (SEQ ID NO:27).

Figure 8:
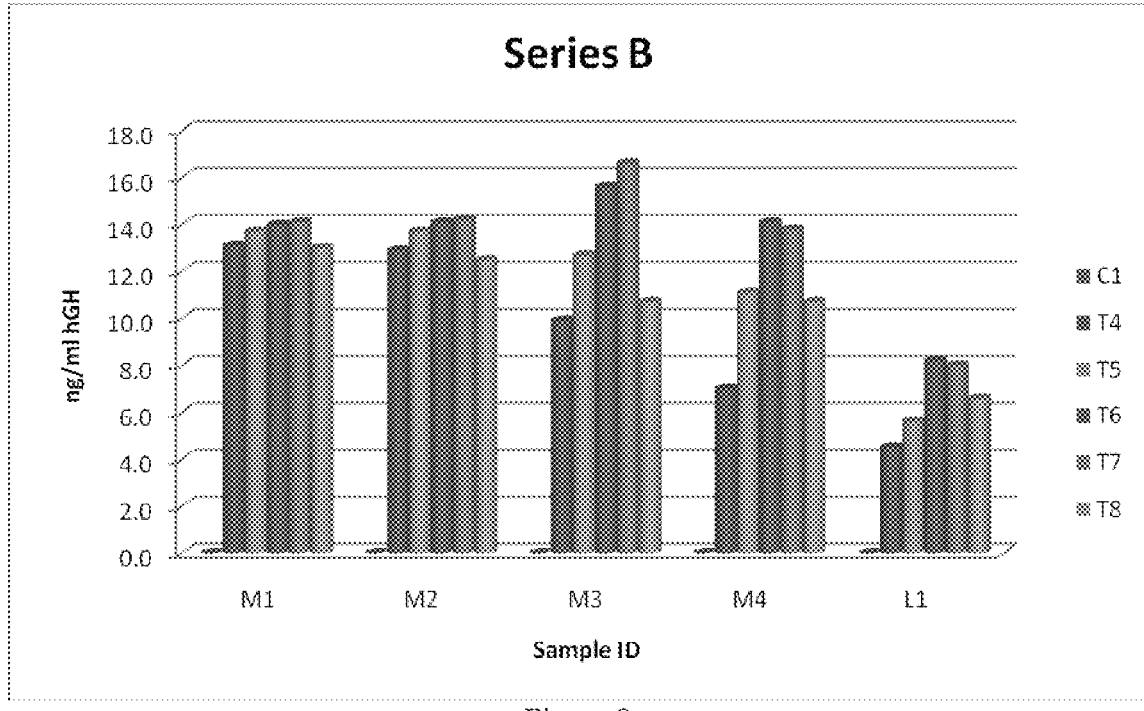
FIG. 8 presents additional GH ELISA results for Experiment 1136. C1, T4, T5, T6, T7, and T8 are displayed in order from left to right at each of M1, M2, M3, M4, and L1.
Figure 9:
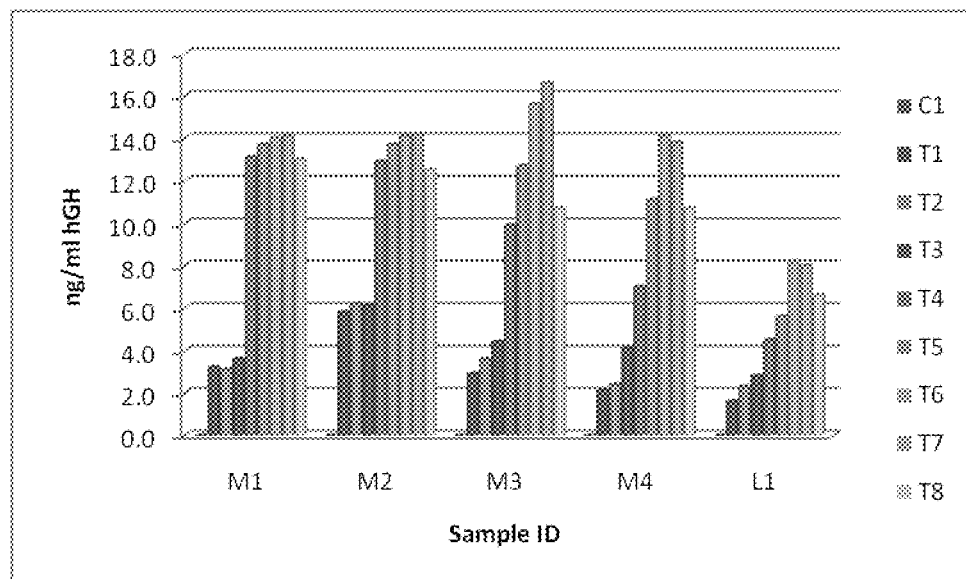
FIG. 9 presents additional GH ELISA results for Experiment 1136. C1, T1, T2, T3, T4, T5, T6, T7, and T8 are displayed in order from left to right at each of M1, M2, M3, M4, and L1.

As in the previous series, all are quite similar in the early samples, but note that in M3, the LysRep and MAR vectors (T6 and T7 (SEQ ID NOs:25 and 26, respectively)) actually continued to increase GH production, and maintain higher levels than the other vectors for the duration of the experiment (FIG. 8). FIG. 9 includes all samples, to provide a comparison of the difference in total protein production between the Series A and Series B vectors.

EXAMPLE 5

Test Transfection of hGH Vectors

Figure 10:
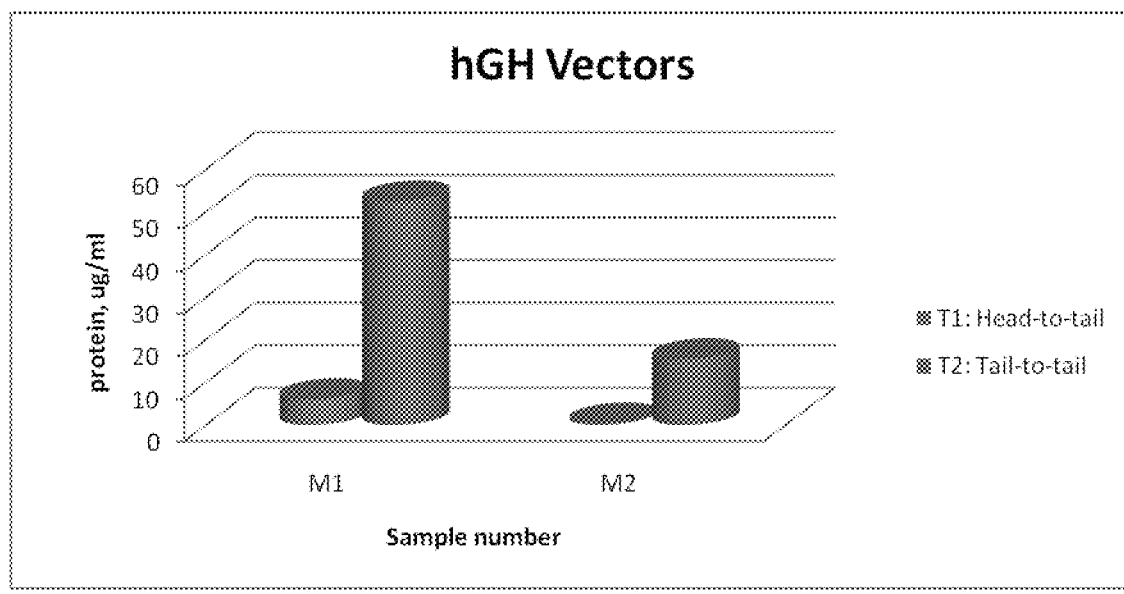
FIG. 10 presents GH ELISA results for Experiment 1151. T1 and T2 are displayed in order from left to right at each of M1 and M2

This experiment compared two versions of new hGH vectors. Both of these vectors were in the TnPuroMAR backbone. However, one of these vectors, (T1 #217) (SEQ ID NO:28), had the hGH expression cassette inserted tail-to-tail (polyA-to-polyA) with the puromycin expression cassette, while the other, (T2 #240) (SEQ ID NO:29), had the hGH cassette inserted head-to-tail with the puromycin cassette, such that the CMV promoter of the hGH cassette immediately followed the polyA of the puromycin cassette, with both cassettes reading in the same direction. Although these vectors were in a puromycin-selectable backbone, they were not exposed to any selection pressure in this experiment. FIG. 10 shows only the first two media samples. Clearly, the tail-to-tail vector (T1, SEQ ID NO:28) expressed much higher levels of 3xFlag-GH in this experiment. (The actual values reported by protein are shown in the table below.)

TABLE 6

|  | 3xFlag-GH (mg/ml) |
| --- | --- |
| T1 (SEQ ID NO: 29).M1 (48 hours) 1:1000 | 6.03 |
| T1 (SEQ ID NO: 29) . . . M2 (96 hours) 1:1000 | 0.35 |
| T2 (SEQ ID NO: 28) . . . M1 (48 hours) 1:10K | 52.48 |
| T2 (SEQ ID NO: 28) . . . M2 (96 hours) 1:10K | 15.47 |

EXAMPLE 6

GH Protein Expression Using Transposon Based Expression Vectors

The disclosed expression vectors have been assayed for their ability to produce GH as discussed above, and in several different cell cultures. Typical results for the expression vectors are shown in Table 7.

TABLE 7

| Vector number | Cell type | Amount of protein |
| --- | --- | --- |
| 153 | TG | 15 µg/ml |
| 153 | LMH2A | 10 µg/ml |
| 157 | TG | 5.8 µg/ml |
| 159 | TG | 13.1 µg/ml |
| 170 | TG | 3.6 µg/ml |
| 171 | TG | 4.35 abs @ 120 min |
| 171 | LMH2A | 40.1 µg/ml |
| 171 | hMyeloma | .35 abs @ 180 min |
| 173 | TG | 5.6 µg/ml |
| 173 | LMH2A | 27 µg/ml |
| 174 | TG | 3.1 µg/ml |
| 174 | LMH2A | 12.8 µg/ml |
| 181 | TG | 3.1 µg/ml |
| 202 | TG | 13.7 µg/ml |
| 203 | TG | 14 µg/ml |
| 204 | TG | 14 µg/ml |
| 235 | LMH2A | 45.3 µg/ml |
| 235 | LMH | 31.8 µg/ml |
| 235 | APRE | 3.6 µg/ml |
| 235 | CHO-K1 | 3.3 µg/ml |
| 268 | LMH | 8.7 µg/ml |
| 268 | LMH2A | 8.5 µg/ml |
| 283 | LMH | 5.1 |
| 283 | LMH2A | 5.0 µg/ml |
| 230 | LMH2A | 38.26 µg/ml |
| 230 | LMH | 27.89 µg/ml |

EXAMPLE 7

TnMAR

Figure 11:
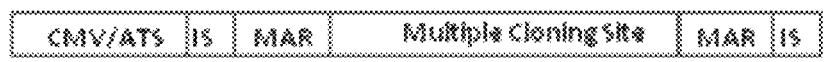
FIG. 11 is a schematic representation of MAR elements incorporated into the transposon backbone. The MAR elements flanked the multiple cloning site which is where the gene of interest and its regulatory components were inserted. The MAR elements can be replaced with the HS4 or LysRep elements, or combinations thereof.

There are two basic inventions that are presented together because of how they work in concert with each other to increase gene expression. The first was developed in an effort to overcome gene silencing in chickens. We have developed several vectors that had insulator elements "in-board" of the insertion sequences of the transposon vector. These include HS4 elements, Lys Rep elements (Lysozyme Replicator), Lys Rep/HS4 elements in combination, and MAR (Matrix Attachment Region) elements (schematically represented in FIG. 11 and shown in different vectors described herein, see Appendix). The goal in designing vectors containing these elements was to identify a system that would prevent our transgene from being bound and silenced by chromatin. While not wanting to be bound by the following statement, in theory, these elements are supposed to inhibit or at least minimize gene silencing. Each of these has been tested in cell culture. To date, the vector containing the MAR and LysRep vectors worked the best with MAR slightly better than Lys-Rep.

Figure 2:
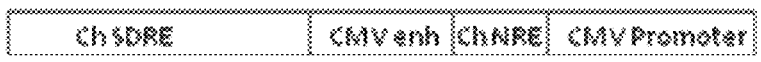
FIG. 2 presents a schematic representation of the construction of SEQ ID NO:15.

A second embodiment of this invention are two hybrid promoters that consist of elements from the constitutive CMV promoter and the estrogen inducible ovalbumin promoter. The goal of designing these promoters was to couple the high rate of expression associated with the CMV promoter with the estrogen inducible function of the ovalbumin promoter. To accomplish this goal, three hybrid promoters, designated versions 1-3 (SEQ ID NOs:14, 15, and base pairs 4937-6465 of SEQ ID NO:19, respectively) (FIGS. 1-2, and Appendix), were designed, built, placed into backbone vectors and tested in cell culture. Of the three, only versions 1 and 2 provided high rates of expression; version 3 provided less and was not considered for further work in cell culture.

Unexpectedly, in cell culture the TnMAR vector provided significantly more GH than previous vectors we had developed, with the exception of the LysRep vectors. Likewise, the hybrid promoters version 1 (SEQ ID NO:14) and 2 (SEQ ID NO:15) out performed the original CMV promoter by a range of 25 to 50% with most samples approaching 50%.

EXAMPLE 8

Immunocytochemical Detection of Human Growth Hormone in Transfected LMH2A Cells

Transfected LMH2A cells were seeded to one well of gelatin-coated 2-well chamber slides and grown in the presence of puromycin. LMH2A control cells (non-transfected) were grown in the second well of each chamber slide without antibiotic. Cells were fixed with 4% neutral buffered formalin and stained using the following method. Cells were permeabilized in 2.5% cold methanol for 5 min. Blocking buffer included 2.5% normal horse serum in phosphate buffered saline and 0.01% Triton X-100 for 20 min. Primary antiserum employed were anti-3× flag-fluorescein isothiocyanate (FITC) Bug/ml or mouse anti-hGH ab9821 1:1000 dilution (1 ug/ml) for 60 min. Secondary antisera were anti-mouse Ig-FITC 1:500 or anti-mouse Ig-rhodamine 1:500 for 30 min.

Fluorescent labeling of cells expressing hGH was observed with a Zeiss Axiovert 200 Microscope. Non-transfected LMH2A control cells showed some autofluorescence but no staining with FITC-conjugated antibody, by either direct detection with anti-3xFlag-FITC or indirect detection using mouse anti-hGH with anti-mouse Ig-FITC or rhodamine secondary antibody. The puromycin-selected transfected LMH2A cells showed a majority of the cell population specifically labeled with the direct and indirect methods of detection listed above, demonstrating hGH synthesis in the transfected LMH2A cells.

EXAMPLE 9

Perfusion of LMH2A Cells in Auto VaxID

The AutoVaxID cultureware (Biovest) was installed and the Fill-Flush procedure was performed following the procedures in the AutoVaxID Operations Manual. The following day, the pre-inoculation procedure and the pH calibration were done. The cultureware was seeded with $10^9$ LMH2A cells containing vector #230 (SEQ ID NO:31). The cells had been propagated in Lonza UltraCULTURE media supplemented with cholesterol (Sigma, 50 ug/ml) in 20 gelatin-coated T150 cell culture flasks, and had been dissociated with Accutase (Sigma). They were counted, gently pelleted (600×G for 6 minutes) and resuspended in 50 mls of growth media (Lonza UltraCULTURE containing GlutaMax (Invitrogen) and SyntheChol (1:500), Soy Hydrolysate (1:50), and Fatty Acid Supplement (1:500) (all from Sigma). This is the same media which was included in the "Factor" bags for the AutoVaxID, used for the EC (extra-capillary) media. A 10 L bag of Lonza UltraCULTURE media (with GlutaMax) was used initially for the IC (intra-capillary) media. This was designed to give the cells a richer media for the first 7-10 days, to allow them to become established quickly in the hollow fiber system. After this bag was exhausted, the IC media was switched to DMEM/F12 (also including GlutaMax), also purchased from Lonza. This media was purchased in SOL drums, and was removed from the cold room and allowed to warm to room temperature before being connected to the system. The AutoVaxID system was placed under Lactate Control, and pump rates were modified and daily tasks performed, as specified by the AutoVaxID Operating Procedures Manual, provided by the manufacturer (Biovest).

Figure 12:
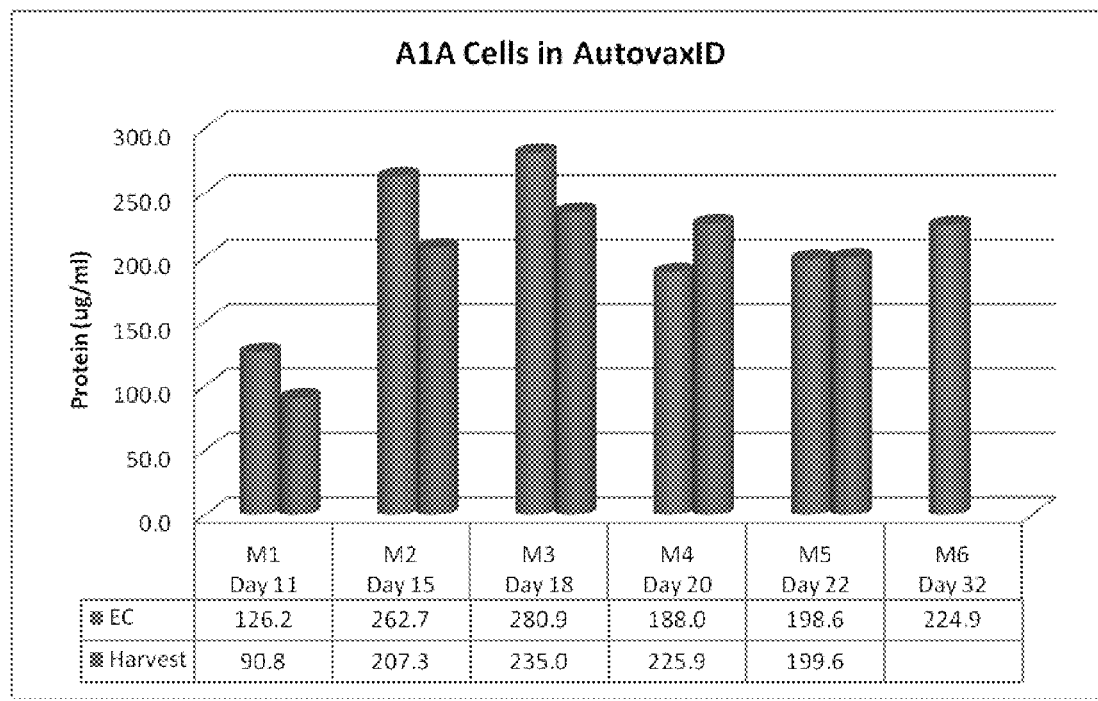
FIG. 12 is a schematic representation of 3xFlag-hGH output from LMH2A cells (A1A clone) in a perfusion system. EC and Harvest are are displayed in order from left to right at each of M1, M2, M3, M4, M5, and M6.

Six days later cells could clearly be seen growing on the hollow fibers in the bioreactor. Up until this time, there was ample evidence that the cells were growing and metabolizing in the system; the Lactate Controller had been increasing the media pump rate regularly in order to keep the lactate levels below the setpoint, and the pH Controller had been continually decreasing the percentage of $CO_2$ in the gas mix, indicating that the cells were producing increasing amounts of acidic metabolic products. After the IC media was changed from the Lonza UltraCULTURE media to the DMEM/F12, however, the metabolic rate of the cells appeared to slow dramatically, to the point where the Lactate Controller had slowed the media pumps all the way to baseline levels, and the lactate levels were still dropping. Samples were taken for protein analysis 4 days later (Day 11). Samples were taken from the EC media (showing current production) from the Harvest Bag (showing accumulated production) and from the IC media (showing any protein which crossed the membrane and was lost in the wasted media). By four days later (Day 15), there was both visual and metabolic evidence that the cells were growing, so cycling was initiated. For the next week, regular sampling was continued, and cells appeared to be growing and metabolizing normally, although it was becoming physically difficult to pull samples from the EC sample port. The run was allowed to continue until Day 32, although cycling times became greatly extended. Final samples were taken, and the run was ended. All samples were analyzed for proteins. FIG. 12 shows the amounts of 3xFlag-hGH in each of the EC and harvest samples (Day 11, 15, 18, 20, 22, and 32). The cells were clearly capable of producing significant amounts of protein in this system.

EXAMPLE 10

Construction of Vectors #133/#159 (SEQ ID NO:30)

The pTopo containing the human growth hormone (hGH) cassette driven by the hybrid promoter version 1 (SEQ ID NO:14) was digested with restriction enzymes Asc I and Pac I (New England Biolabs, Beverly, Mass.) according to the manufacturer's protocol. Digested DNA was purified from restriction enzymes using a Zymo DNA Clean and Concentrator kit (Zymo Research). To insert the growth hormone cassette into the MCS of the p5006 vector (SEQ ID NO:3), the purified hGH DNA and the p5006 vector (SEQ ID NO:3) were digested with Asc I and Pac I, purified as described above, and ligated using a Quick T4 DNA Ligase Kit (New England Biolabs, Beverly, Mass.) according to the manufacturer's protocol. Ligated product was transformed into E. coli Top10 competent cells (Invitrogen Life Technologies, Carlsbad, Calif.) using chemical transformation according to Invitrogen's protocol. Transformed bacteria were incubated in 0.25 ml of SOC (GIBCO BRL, CAT#15544-042) medium for 1 hour at 37° C. before being spread to LB (Luria-Bertani media (broth or agar)) plates supplemented with 100 µg/ml ampicillin (LB/amp plates). These plates were incubated overnight at 37° C., and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining. Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify that the changes made in the vector were the desired changes and that no further changes or mutations occurred. All sequencing was done on a Beckman Coulter CEQ 8000 Genetic Analysis System.

Once a clone was identified that contained the hGH gene, the DNA was isolated by standard procedures. Briefly, E. coli containing the plasmid was grown in 500 mL aliquots of LB broth (supplemented with an appropriate antibiotic) at 37° C. overnight with shaking. Plasmid DNA was recovered from the bacteria using a Qiagen EndoFree Plasmid Maxi-Prep kit (Qiagen, Inc., Chatsworth, Calif.) according to the manufacturer's protocol. Plasmid DNA was resuspended in 500 µL of Endotoxin free water and stored at −20° C. until needed.

EXAMPLE 11

Production of Transgenic Chicken and Quail that Successfully Passed the hGH Transgene Through Two Generations Using SEQ ID NO:30

Separate in vivo experiments in chicken and quail have demonstrated successful passage of the transgene encoding for hGH contained in SEQ ID NO:30 through two generations. Briefly, germ line cells of both chicken and quail were made transgenic following administration of SEQ ID NO:30 containing a gene encoding for human growth hormone (hGH), into the left cardiac ventricle, the source of the aorta which provides an artery leading to the ovary; 2) These birds were mated with naïve males and the resulting eggs hatched. These chicks (G1 birds) contained the transgene encoding hGH as their blood cells were positive for the transgene encoding hGH or the transgene encoding hGH, and 3) These transgenic progeny (G1 birds) were subsequently bred and their progeny (G2 birds) were positive for the transgene encoding hGH.

Transgenic G1 and G2 quail were generated by injecting females in the left cardiac ventricle. The experiment employed 5, seven week old quail hens. The hens were each injected into the left ventricle, allowed to recover, and then mated with naïve males. Isofluorane was used to lightly anesthetize the birds during the injection procedure. Eggs were collected daily for six days and set to hatch on the $7^{th}$ day. At about 2 weeks of age, the chicks were bled and DNA harvested as described in a kit protocol from Qiagen for isolating genomic DNA from blood and tissue. PCR was conducted using primers specific to the gene of interest. In both experiments, transgene-positive G1 animals were obtained. These transgene-positive G1 animals were raised to sexual maturity and bred. The G2 animals were screened at 2 weeks of age and transgenic animals were identified in each experiment. A transposon-based vector (SEQ ID NO:30) containing a gene for a hGH was injected. A total of 85 µg complexed with branched polyethylamine (BPEI) in a 300 µL total volume was used. G1 and G2 quail were positive for the hGH transgene following analysis of blood samples.

Transgenic G1 and G2 chickens were generated by injecting females in the left cardiac ventricle. The experiment was conducted in 20 week old chickens. In the second experiment, the same transposon-based vector (SEQ ID NO:30) containing a gene for a hGH as described above for quail was injected. DNA (complexed to BPEI) was delivered to the birds at a rate of 1 mg/kg body (up to 3 ml total volume) weight by injection into the left cardiac ventricle. Isofluorane was used to lightly anesthetize the birds during the injection procedure. Once the birds recovered from the anesthesia, they were place in pens with mature, naïve males. All eggs were collected for 5 days and then incubated. In the first experiment, the eggs were incubated for about 12 days, candled to check for viable embryos; any egg showing a viable embryo was cracked open and tissue samples (liver) taken from the embryo for PCR. The eggs were allowed to hatch, and a blood sample was taken at two days to test the animals for the presence of the transgene using PCR. Approximately 14% of the chicks were positive for the hGH transgene.

EXAMPLE 12

Production of Human Growth Hormone from Transfected Tubular Gland Cells In Vitro Using SEQ ID NO:30

Oviducts were harvested from 19-22 week old white leghorn hens and cleaned by removing the infundibulum, shell gland, membranes, and blood vessels to leave the magnum portion of the oviduct. The tissue was minced into about 2 mm$^2$ pieces and dissociated into single or multi-cell clumps using Liberase 2 Blendzyme (Roche). The tubular gland cell population was enriched by centrifuging the dissociated cells on a Percoll SIP gradient and removing the top layer. These cells were allowed to attach in T25 flasks for 24-48 hours in DMEM/F12 Advanced media supplemented with 10% fetal calf serum. Once attached, the media was gently poured off and 2 µg of DNA (containing vector SEQ ID NO:30) was complexed with Fugene-6 in a final volume of 1 ml media was added to the cells and incubated at 37° C. for 1-2 hours. After incubation, the DNA/Fugene complex was removed and fresh media added to the flask. Media was harvested every 48 hours (for a total of three harvests designated M1, M2, and M3) and stored at 4° C. until the experiment was completed. Once all samples were obtained, an ELISA was conducted using anti-3xFlag antibody. Numerous experiments were conducted. As an example, vector 159 yielded an absorbance of 0.745 compared to the negative control absorbance of 0.065 and the positive control absorbance of 0.644 (180 min reading at 405 nm). This was the highest absorbance obtained in this experiment. These samples were also used on a Western blot using anti-3xFlag as the detection antibody and a 27 KD band corresponding to the 3xFlag growth hormone was observed to be the same size as the positive control band. These results demonstrate that Vector 133/159 (SEQ ID NO:30) was successfully used to transfect tubular gland cells that synthesized and secreted 3xFlag human growth hormone.

All patents, publications and abstracts cited above are incorporated herein by reference in their entirety. It should be understood that the foregoing relates only to preferred embodiments of the present invention and that numerous modifications or alterations may be made therein without departing from the spirit and the scope of the present invention as defined in the following claims.

---

SEQUENCE LISTING (52 sequences)

SEQ ID NO: 1 - DNA, 7368 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctctagaactagtggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactactccgggatcatatgacaagatgtgtatccaccttaacttaatgatttttaccaaaatcattaggggattcatcagtgctcagggtcaacgagaattaacattccgtcaggaaagcttatgatgatgatgtgcttaaaaacttactcaatggctggtttatgcatatcgcaatacatgcgaaaaacctaaaagagcttgccgataaaaaaggccaatttattgctatttaccgcggctttttattgagcttgaaagataaataaaatagataggttttatttgaagctaaatcttctttatcgtaaaaaatgccctcttgggttatcaagagggtcattatatttcgcggaataacatcatttggtgacgaaataactaagcacttgtctcctgtttactcccctgagcttgaggggttaacatgaaggtcatcgatagcaggataataatacagtaaaacgctaaaccaataatccaaatccagccatcccaaattggtagtgaatgattataaataacagcaaacagtaatgggccaataacaccggttgcattggtaaggctcaccaataatccctgtaaagcaccttgctgatgactctttgtttggatagacatcactccctgtaatgcaggtaaagcgatcccaccaccagccaataaaattaaaacagggaaaactaaccaaccttcagatataaacgctaaaaaggcaaatgcactactatctgcaataaatccgagcagtactgccgttttttcgccccatttagtggctattcttcctgccacaaaggcttggaatactgagtgtaaaagaccaagacccgctaatgaaaagccaaccatcatgctattccatccaaaacgattttcggtaaatagcacccacaccgttgcaggaatttggcctatcaatgcgctgaaaaataataaatcaacaaaatgggcatcgttttaaataaagtgatgtataccgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 2 - DNA, 7455 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgagcgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctctagaactagtggatcccccgggctgcaggaattcgatatcaagcttatcgataccgtcgacctcgagggcgcgcctcagcgatcgcagatctttaattaaggcgcctgcaggatttaaatcacgtgatcacgtcgtacgcaattggtttaaacgcgtgggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactactccgggatcatatgacaagatgtgtatccaccttaacttaatgatttttaccaaaatcattaggggattcatcagtgctcagggtcaacgagaattaacattccgtcaggaaagcttatgatgatgatgtgcttaaaaacttactcaatggctggtttatgcatatcgcaatacatgcgaaaaacctaaaagagcttgccgataaaaaaggccaatttattgctatttaccgcggctttttattgagcttgaaagataaataaaatagataggttttatttgaagctaaatcttctttatcgtaaaaaatgccctcttgggttatcaagagggtcattatatttcgcggaataacatcatttggtgacgaaataactaagcacttgtctcctgtttactcccctgagcttgaggggttaacatgaaggtcatcgatagcaggataataatacagtaaaacgctaaaccaataatccaaatccagccatcccaaattggtagtgaatgattataaataacagcaaacagtaatgggccaataacaccggttgcattggtaaggctcaccaataatccctgtaaagcaccttgctgatgactctttgtttggatagacatcactccctgtaatgcaggtaaagcgatcccaccaccagccaataaaattaaaacagggaaaactaaccaaccttcagatataaacgctaaaaaggcaaatgcactactatctgcaataaatccgagcagtactgccgttttttcgccccatttagtggctattcttcctgccacaaaggcttggaatactgagtgtaaaagaccaagacccgctaatgaaaagccaaccatcatgctattccatccaaaacgattttcggtaaatagcacccacaccgttgcgggaatttggcctatcaattgcgctgaaaaataaataatcaacaaaatgggcatcgttttaaataaagtgatgtataccgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 3 - DNA, 8590 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgagcgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagggcgcgcctcagcgatcgcagatctttaattaaggcgcctgcaggatttaaatcacgtgatcacgtcgtacgcaattggtttaaacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 4 - DNA, 8584 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagggcgcgcctcagcgatcgcagatctttaattaaggcgcctgcaggatttaaatcacgtgatcacgtcgtacgcaattggtttaaacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 5 - DNA, 9486 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacgcaattggtttaaacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 6 - DNA, 9286 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcgccgtgtattgattgctcagtgaagtcagacctgctcctctcagcatccttcaccatcgctcagccctggcagagtttctatcatcccttgtcatcagctgcatgagcaacgctcagaagtcagccctcttctctcttttgtagcttatctttacattagtatcaacaaaatgcaaacatagataaaaggaggatttttatagatgccttattaacagaagctacttactcactgagtgcaagcttacttaaaacaagctctgaaaggatcattctccccctcccactctactgaagtgctgctagtactactaattcagactgggtgaatttactcttgcttgaatccagcacaagtcatgtgtactctggggaagagggggattaaacagcttttaaattatgtttggaagtccttctcacaactctgttcaggggagggttttatccactactacttttattttattttattttattttattttattttattttgttttattttattttatttattttggcattgtttatgtgtatattcatgggtttggatcgtgtcaaggctgctagatagtctttcatcactttgtagcatttaacgtttttggaaaacattatctgggttaatacatattacaaaaaatgagcattcagtctttttctctctgtcttaatttaaatgcagttttgattgaggctgaacttatgtatttttaattgcaaataaatgttctgttccctcctttgctttttttctttgtcttttctttgaaactagatgcttcctttgttttctgtttatgaaaccttttccagaaaatgattacttcatgtatgggtctttggtggcacatagagattctgcagatattattttaattaggttgcttggttccatttcatgtctaaatggctgtggcatggaccttgcgctcgagggcgcgcctcagcgatcgcagatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtgccgtgtattgattgctcagtgaagtcagacctgctcctctcagcatccttcaccatcgctcagccctggcagagtttctatcatcccttgtcatcagctgcatgagcaacgctcagaagtcagccctcttctctcttttgtagcttatctttacattagtatcaacaaaatgcaaacatagataaaaggaggatttttatagatgccttattaacagaagctacttactcactgagtgcaagcttacttaaaacaagctctgaaaggatcattctccccctcccactctactgaagtgctgctagtactactaattcagactgggtgaatttactcttgcttgaatccagcacaagtcatgtgtactctggggaagagggggattaaacagcttttaaattatgtttggaagtccttctcacaactctgttcaggggagggttttatccactactacttttattttattttattttattttattttattttattttgttttattttattttatttattttggcattgtttatgtgtatattcatgggtttggatcgtgtcaaggctgctagatagtctttcatcactttgtagcatttaacgtttttggaaaacattatctgggttaatacatattacaaaaaatgagcattcagtctttttctctctgtcttaatttaaatgcagttttgattgaggctgaacttatgtatttttaattgcaaataaatgttctgttccctcctttgctttttttctttgtcttttctttgaaactagatgcttcctttgttttctgtttatgaaaccttttccagaaaatgattacttcatgtatgggtctttggtggcacatagagattctgcagatattattttaattaggttgcttggttccatttcatgtctaaatggctgtggcatggaccttgcggggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 7 - DNA, 9902 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagggcgcgcctcagcgatcgcagatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 8 - DNA, 10804 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 9 - DNA, 11248 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcaggactcttcctttttcaatattattgaagcatttatcagggttattgtctcatgagcggatacatatttgaatgtatttagaaaaataaacaaataggggttccgcgcacatttccccgaaaagtgccacctgacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 10 - DNA, 8893 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccacgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacgcaattggtttaaacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 11 - DNA, 10211 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccacgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 12 - DNA, 9204 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccactgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcctcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacgcaattggtttaaacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 13 - DNA, 10522 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccactgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcctcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 14 - DNA, 1514 bp, Artificial Sequence
  Synthetic Construct
gtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaagtttgttataaagcattcacacccataaaaagatagatttaaatattccagctataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtagatacaagaaggatcaaatgaaacagacttctggtctgttactacaaccatagtaataagcacactaactaataattgctaattatgttttccatctctaaggttcccacatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcgtggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccg

SEQ ID NO: 15 - DNA, 1124 bp, Artificial Sequence
  Synthetic Construct
tggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgatggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactcgtaataagcacactaactaataattgctaattatgttttccatctctaaggttcccacatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatccccgccccattgacgcaaatgggcggtaggcgtgtacggtgggaggtctatataagcagagctcgtttagtgaaccg

SEQ ID NO: 16 - DNA, 108 bp, Artificial Sequence
  Synthetic Construct
tatctcgagggcgcgcctcagcgatcgcagatctttaattaaggcgcctgcaggatttaaatcacgtgatcacgtcgtacgcaattggtttaaacgcgtgggcccttt

SEQ ID NO: 17 - DNA, 13675 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgagcgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaagtttgttataaagcattcacacccataaaaagatagatttaaatattccagctataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattctgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctgccgctgccctgatcctggctggggtgatgggacagaccttggctgccactgagacatctgagacactgagatctgtctcaactcagatttacccaagaacagatcattgccaacagaacaaaatctcaaacttatggctagtgatgacagcagtcagttgtcccatctgtgacccaccaaggctggcatgctggaatgagcaggctttggtggcttgtagttactggacagcaccactgacatgggcaggggaaaaactgagcatggtgtaaatcactgcctcaaagccacttctctgtgcctgcaccatgcttgaaagctcttctacaggagctgggtttgttcaagaaagcttctgtttctcccatctgcttcttgtaccttcacagggacagagttagaagggtacagccatggctggaaggggctgactttcaaatgtgcctaattttcctttggttgctgctgcagctgcagaagaaggggttcagaagccaagagctttgagataaggatgcctaccctatgttgaagacatttgtgctgacacctcaggccccaggataggacaactgctggattgtggctaacccactagctacagaacctaatttatattaccagattaggaagagcaaaagaacatgtatttataacaggaggtcttctgtgcttctctactaaaaggtgctgtgaaggagcccacagtgcagcagtgtatgaggcctgaaagaggccgcagcacacgaagagccctggtaggagcagcacacagaggggcaggagggctgggggaactgccacccatggggacctgtgtgaagcagtgcactcctgaggggtggactgcgtgggaaaggaaaagaaagcaaacagacctgtgatgaactgtcacacagactgcagagtgacagaggagggcttgaggcagtgcgcttactgcagggagtggcgctccttcctcacagcagcgctaacagcttgttaattaaggcgcctgcaggatttaaatcacgtgatcacgtcgtacgcaattggtttaaacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 18 - DNA, 13297 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgagcgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagggcgcgcctggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgagaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactcgccggcgtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccggtacccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattctgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctgccgctgccctgatcctggctggggtgatgggacagaccttggctgccactgagacatctgagacactgagatctgtctcaactcagatttacccaagaacagatcattgccaacagaacaaaatctcaaacttatggctagtgatgacagcagtcagttgtcccatctgtgacccaccaaggctggcatgctggaatgagcaggctttggtggcttgtagttactggacagcaccactgacatgggcaggggaaaaactgagcatggtgtaaatcactgcctcaaagccacttctctgtgcctgcaccatgcttgaaagctcttctacaggagctgggtttgttcaagaaagcttctgtttctcccatctgcttcttgtaccttcacagggacagagttagaagggtacagccatggctggaaggggctgactttcaaatgtgcctaattttcctttggttgctgctgcagctgcagaagaaggggttcagaagccaagagctttgagataaggatgcctaccctatgttgaagacatttgtgctgacacctcaggccccaggataggacaactgctggattgtggctaacccactagctacagaacctaatttatattaccagattaggaagagcaaaagaacatgtatttataacaggaggtcttctgtgcttctctactaaaaggtgctgtgaaggagcccacagtgcagcagtgtatgaggcctgaaagaggccgcagcacacgaagagccctggtaggagcagcacacagaggggcaggagggctgggggaactgccacccatggggacctgtgtgaagcagtgcactcctgaggggtggactgcgtgggaaaggaaaagaaagcaaacagacctgtgatgaactgtcacacagactgcagagtgacagaggagggcttgaggcagtgcgcttactgcagggagtggcgctccttcctcacagcagcgctaacagcttgttaattaaggcgcctgcaggatttaaatcacgtgatcacgtcgtacgcaattggtttaaacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 19 - DNA, 13681 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgagcgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagggcgcgcctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgtttttggcaccaaaatcaacgggactttccaaaatgtcgtaacaactcgccggcgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaagtttgttataaagcattcacacccataaaaagatagatttaaatattccaactataggaaagaaagtgcgtctgctcttcactctagtctcagatggctccttcacatgcagcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcgggtacccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattctgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctgccgctgccctgatcctggctggggtgatgggacagaccttggctgccactgagacatctgagacactgagatctgtctcaactcagatttacccaagaacagatcattgccaacagaacaaaatctcaaacttatggctagtgatgacagcagtcagttgtcccatctgtgacccaccaaggctggcatgctggaatgagcaggctttggtggcttgtagttactggacagcaccactgacatgggcaggggaaaaactgagcatggtgtaaatcactgcctcaaagccacttctctgtgcctgcaccatgcttgaaagctcttctacaggagctgggtttgttcaagaaagcttctgtttctcccatctgcttcttgtaccttcacagggacagagttagaagggtacagccatggctggaaggggctgactttcaaatgtgcctaattttcctttggttgctgctgcagctgcagaagaaggggttcagaagccaagagctttgagataaggatgcctaacctatgttgaagacatttgtgctgacacctcaggccccaggataggacaactgctggattgtggctaacccactagctacagaacctaatttatattaccagattaggaagagcaaaagaacatgtatttataacaggaggtcttctgtgcttctctactaaaaggtgctgtgaaggagcccacagtgcagcagtgtatgaggcctgaaagaggccgcagcacacgaagagccctggtaggagcagcacacagaggggcaggagggctgggggaactgccacccatggggacctgtgtgaagcagtgcactcctgaggggtggactgcgtgggaaaggaaaagaaagcaaacagacctgtgatgaactgtcacacagactgcagagtgacagaggagggcttgaggcagtgcgcttactgcagggagtggcgctccttcctcacagcagcgctaacagcttgttaattaaggcgcctgcaggatttaaatcacgtgatcacgtcgtacgcaattggtttaaacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 20 - DNA, 15994 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgagcgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagggcgcgccgccaggtggactatgaactcacatccaaaggagcttgacctgatacctgattttcttcaaactggggaaacaacacaatcccacaaaacagctcagagagaaaccatcactgatggctacagcaccaaggtatgcaatggcaatccattcgacattcatctgtgacctgagcaaaatgatttatctctccatgaatggttgcttctttccctcatgaaaaggcaatttccacactcacaatatgcaacaaagacaaacagagaacaattaatgtgctccttcctaatgtcaaaattgtagtggcaaagaggagaacaaaatctcaagttctgagtaggttttagtgattggataagaggctttgacctgtgagctcacctggacttcatatccttttggataaaaagtgcttttataactttcaggtctccgagtctttattcatgagactgttggtttagggacagacccacaatgaaatgcctggcataggaaagggcagcagagccttagctgaccttttcttgggacaagcattgtcaaacaatgtgtgacaaaactatttgtactgctttgcacagctgtgctgggcagggcaatccattgccacctatcccaggtaaccttccaactgcaagaagattgttgcttactctctctagaaagcttctgcagactgacatgcatttcataggtagagataacatttactgggaagcacatctatcatcataaaaagcaggcaagattttcagactttcttagtggctgaaatagaagcaaaagacgtgattaaaaacaaaatgaaacaaaaaaaatcagttgatacctgtggtgtagacatccagcaaaaaaatattatttgcactaccatcttgtcttaagtcctcagacttggcaaggagaatgtagatttctacagtatatatgttttcacaaaaggaaggagagaaacaaaagaaaatggcactgactaaacttcagctagtggtataggaaagtaattctgcttaacagagattgcagtgatctctatgtatgtcctgaagaattatgttgtacttttttcccccatttttaaatcaaacagtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaagtttgttataaagcattcacacccataaaaagatagatttaaatattccagctataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtagatacaagaaggatcaaatgaaacagacttctggtctgttactacaaccatagtaataagcacactaactaataattgctaattatgttttccatctctaaggttcccacatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcgtcaaaggtcaaacttctgaagggaacctgtgggtgggtcacaattcaggctatatattccccagggctcagccagtggatcaacatacagctagaaagctgtattgcctttagcagtcaagctcgaaaggtaagcaactctctggaattaccttctctctatattagctcttacttgcacctaaactttaaaaaattaacaattattgtgctatgtgttgtatctttaagggtgaagtacctgcgtgataccccctataaaaacttctcacctgtgtatgcattctgcactattttattatgtgtaaaagctttgtgtttgttttcaggaggcttattctttgtgcttaaaatatgtttttaatttcagaacatcttatcctgtcgttcactatctgatatgctttgcagtttgcttgattaacttctagccctacagagtgcacagagagcaaaatcatggtgttcagtgaattctggggagttattttaatgtgaaaattctctagaagtttaattcctgcaaagtgcagctgctgatcactacacaagataaaaatgtggggggtgcataaacgtatattcttacaataatagatacatgtgaacttatatacagaaaagaaaatgagaaaaatgtgtgtgtgtatactcacacacgtggtcagtaaaaacttttgaggggtttaatacagaaaatccaatcctgaggccccagcactcagtacgcatataaagggctgggctctgaaggacttctgactttcacagattatataaatctcaggaaagcaactagattcatgctggctccaaaagctgtgctttatataagcacactggctatacaatagttgtacagttcagctctttataatagaaacagacagaacaagtataaatcttctattggtctatgtcatgaacaagaattcattcagtggctctgttttatagtaaacattgctattttatcatgtctgcatttctcttctgtctgaatgtcaccactaaaatttaactccacagaaagtttatactacagtacacatgcatatctttgagcaaagcaaaccatacctgaaagtgcaatagagcagaatatgaattacatgcgtgtctttctcctagactacatgaccccatataaactacattccttatctattctgccatcaccaaaacaaaggtaaaaatacttttgaagatctactcatagcaagtagtgtgcaacaaacagatatttctctacatttatttttagggaataaaaataagaaataaaatagtcagcaagcctctgctttctcatatatctgtccaaacctaaagtttactgaaatttgctctttgaatttccagttttgcaagcctatcagattgtgttttaatcagaggtactgaaaagtatcaatgaattctagctttcactgaacaaaaatatgtagaggcaactggcttctgggacagtttgctacccaaaagacaactgaatgcaaatacataaatagatttatgaatatggttttgaacatgcacatgagaggtggatatagcaacagacacattaccacagaattactttaaaactacttgttaacatttaattgcctaaaaactgctcgtaatttactgttgtagcctaccatagagtaccctgcatggtactatgtacagcattccatccttacattttcactgttctgctgtttgctctagacaactcagagttcaccatgggctccatcggtgcagcaagcatggaattttgttttgatgtattcaaggagctcaaagtccaccatgccaatgagaacatcttctactgccccattgccatcatgtcagctctagccatggtatacctgggtgcaaaagacagcaccaggacacaaataaataaggttgttcgctttgataaacttccaggattcggagacagtattgaagctcagtgtggcacatctgtaaacgttcactcttcacttagagacatcctcaaccaaatcaccaaaccaaatgatgtttattcgttcagccttgccagtagactttatgctgaagagagatacccaatcctgccagaatacttgcagtgtgtgaaggaactgtatagaggaggcttggaacctatcaactttcaaacagctgcagatcaagccagagagctcatcaattcctgggtagaaagtcagacaaatggaattatcagaaatgtccttcagccaagctccgtggattctcaaactgcaatggttctggttaatgccattgtcttcaaaggactgtgggagaaagcatttaaggatgaagacacacaagcaatgcctttcagagtgactgagcaagaaagcaaacctgtgcagatgatgtaccagattggtttatttagagtggcatcaatggcttctgagaaaatgaagatcctggagcttccatttgccagtgggacaatgagcatgttggtgctgttgcctgatgaagtctcaggccttgagcagcttgagagtataatcaactttgaaaaactgactgaatggaccagttctaatgttatggaagagaggaagatcaaagtgtacttacctcgcatgaagatggaggaaaaatacaacctcacatctgtcttaatggctatgggcattactgacgtgtttagctcttcagccaatctgtctggcatctcctcagcagagagcctgaagatatctcaagctgtccatgcagcacatgcagaaatcaatgaagcaggcagagaggtggtagggtcagcagaggctggagtggatgctgcaagcgtctctgaagaatttagggctgaccatccattcctcttctgtatcaagcacatcgcaaccaacgccgttctcttctttggcagatgtgtttctgccggcccagaggaggcaatggcagcagaggaggcaatggcagcagaggaggcaatggcagcgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattctgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactagtgggtgagaagttgaacaagagtcccctacaagcaacttaatctaataagctagtggtctacatcagctaaaagagcatagtgagggatgaaattggttctcctttctaagcatcacctgggacaactcatctggagcagtgtgtccaatctgccgctgccctgatctcggctggggtgatgggacagaccttggctgccactgagacatctgagacactgagatctgtctcaactcagatttacccaagaacagctcattgccaacagaacaaaatctcaaacttatggctagtgatgacagcagtcagttgtcccatctgtgacccaccaaggctggcatgctggaatgagcaggctttggtggcatgtagttactggacagcaccactgacatgggcaggggaaaaactgagcatggtgtaaatcactgcctcaaagccacttctctgtgcctgcaccatgcttgaaagctcttctacaggagctgggtttgttcaagaaagcttctgtttctcccatctgcttcttgtaccttcacagggacagagttagaagggtacagccatggctggaaggggctgactttcaaatgtgcctaattttcctttggttgctgctgcagctgcagaagaaggggttcagaagccaagagctttgagataaggatgcctaacctatgttgaagacatttgtgctgacacctcaggccccaggataggacaactgctggattgtggctaacccactagctacagaacctaatttatattaccagattaggaagagcaaaagaacatgtatttataacaggaggtcttctgtgcttctctactaaaaggtgctgtgaaggagcccacagtgcagcagtgtatgaggcctgaaagaggccgcagcacacgaagagccctggtaggagcagcacacagaggggcaggagggctgggggaactgccacccatggggacctgtgtgaagcagtgcactcctgaggggtggactgcgtgggaaaggaaaagaaagcaaacagacctgtgatgaactgtcacacagactgcagagtgacagaggagggcacgaggcagtgcgcccactgcagggagtggcgctccttcctcacagcagcgcttaattaaggcgcctgcaggatttaaatcacgtgatcacgtcgtacgcaattggtttaaacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 21 - DNA, 15988 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagggcgcgccgccaggtggactatgaactcacatccaaaggagcttgacctgatacctgattttcttcaaactggggaaacaacacaatcccacaaaacagctcagagagaaaccatcactgatggctacagcaccaaggtatgcaatggcaatccattcgacattcatctgtgacctgagcaaaatgatttatctctccatgaatggttgcttctttccctcatgaaaaggcaatttccacactcacaatatgcaacaaagacaaacagagaacaattaatgtgctccttcctaatgtcaaaattgtagtggcaaagaggagaacaaaatctcaagttctgagtaggttttagtgattggataagaggctttgacctgtgagctcacctggacttcatatccttttggataaaaagtgcttttataactttcaggtctccgagtctttattcatgagactgttggtttagggacagacccacaatgaaatgcctggcataggaaagggcagcagagccttagctgaccttttcttgggacaagcattgtcaaacaatgtgtgacaaaactatttgtactgctttgcacagctgtgctgggcagggcaatccattgccacctatcccaggtaaccttccaactgcaagaagattgttgcttactctctctagaaagcttctgcagactgacatgcatttcataggtagagataacatttactgggaagcacatctatcatcataaaaagcaggcaagattttcagactttcttagtggctgaaatagaagcaaaagacgtgattaaaaacaaaatgaaacaaaaaaaatcagttgatacctgtggtgtagacatccagcaaaaaaatattatttgcactaccatcttgtcttaagtcctcagacttggcaaggagaatgtagatttctacagtatatatgttttcacaaaaggaaggagagaaacaaaagaaaatggcactgactaaacttcagctagtggtataggaaagtaattctgcttaacagagattgcagtgatctctatgtatgtcctgaagaattatgttgtacttttttcccccatttttaaatcaaacagtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaagtttgttataaagcattcacacccataaaaagatagatttaaatattccagctataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtagatacaagaaggatcaaatgaaacagacttctggtctgttactacaaccatagtaataagcacactaactaataattgctaattatgttttccatctctaaggttcccacatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcgtcaaaggtcaaacttctgaagggaacctgtgggtgggtcacaattcaggctatatattccccagggctcagccagtggatcaacatacagctagaaagctgtattgcctttagcagtcaagctcgaaaggtaagcaactctctggaattaccttctctctatattagctcttacttgcacctaaactttaaaaaattaacaattattgtgctatgtgttgtatctttaagggtgaagtacctgcgtgataccccctataaaaacttctcacctgtgtatgcattctgcactattttattatgtgtaaaagctttgtgtttgttttcaggaggcttattctttgtgcttaaaatatgtttttaatttcagaacatcttatcctgtcgttcactatctgatatgctttgcagtttgcttgattaacttctagccctacagagtgcacagagagcaaaatcatggtgttcagtgaattctggggagttattttaatgtgaaaattctctagaagtttaattcctgcaaagtgcagctgctgatcactacacaagataaaaatgtggggggtgcataaacgtatattcttacaataatagatacatgtgaacttatatacagaaaagaaaatgagaaaaatgtgtgtgtgtatactcacacacgtggtcagtaaaaacttttgaggggtttaatacagaaaatccaatcctgaggccccagcactcagtacgcatataaagggctgggctctgaaggacttctgactttcacagattatataaatctcaggaaagcaactagattcatgctggctccaaaagctgtgctttatataagcacactggctatacaatagttgtacagttcagctctttataatagaaacagacagaacaagtataaatcttctattggtctatgtcatgaacaagaattcattcagtggctctgttttatagtaaacattgctattttatcatgtctgcatttctcttctgtctgaatgtcaccactaaaatttaactccacagaaagtttatactacagtacacatgcatatctttgagcaaagcaaaccatacctgaaagtgcaatagagcagaatatgaattacatgcgtgtctttctcctagactacatgaccccatataaactacattccttatctattctgccatcaccaaaacaaaggtaaaaatacttttgaagatctactcatagcaagtagtgtgcaacaaacagatatttctctacatttatttttagggaataaaaataagaaataaaatagtcagcaagcctctgctttctcatatatctgtccaaacctaaagtttactgaaatttgctctttgaatttccagttttgcaagcctatcagattgtgttttaatcagaggtactgaaaagtatcaatgaattctagctttcactgaacaaaaatatgtagaggcaactggcttctgggacagtttgctacccaaaagacaactgaatgcaaatacataaatagatttatgaatatggttttgaacatgcacatgagaggtggatatagcaacagacacattaccacagaattactttaaaactacttgttaacatttaattgcctaaaaactgctcgtaatttactgttgtagcctaccatagagtaccctgcatggtactatgtacagcattccatccttacattttcactgttctgctgtttgctctagacaactcagagttcaccatgggctccatcggtgcagcaagcatggaattttgttttgatgtattcaaggagctcaaagtccaccatgccaatgagaacatcttctactgccccattgccatcatgtcagctctagccatggtatacctgggtgcaaaagacagcaccaggacacaaataaataaggttgttcgctttgataaacttccaggattcggagacagtattgaagctcagtgtggcacatctgtaaacgttcactcttcacttagagacatcctcaaccaaatcaccaaaccaaatgatgtttattcgttcagccttgccagtagactttatgctgaagagagatacccaatcctgccagaatacttgcagtgtgtgaaggaactgtatagaggaggcttggaacctatcaactttcaaacagctgcagatcaagccagagagctcatcaattcctgggtagaaagtcagacaaatggaattatcagaaatgtccttcagccaagctccgtggattctcaaactgcaatggttctggttaatgccattgtcttcaaaggactgtgggagaaagcatttaaggatgaagacacacaagcaatgcctttcagagtgactgagcaagaaagcaaacctgtgcagatgatgtaccagattggtttatttagagtggcatcaatggcttctgagaaaatgaagatcctggagcttccatttgccagtgggacaatgagcatgttggtgctgttgcctgatgaagtctcaggccttgagcagcttgagagtataatcaactttgaaaaactgactgaatggaccagttctaatgttatggaagagaggaagatcaaagtgtacttacctcgcatgaagatggaggaaaaatacaacctcacatctgtcttaatggctatgggcattactgacgtgtttagctcttcagccaatctgtctggcatctcctcagcagagagcctgaagatatctcaagctgtccatgcagcacatgcagaaatcaatgaagcaggcagagaggtggtagggtcagcagaggctggagtggatgctgcaagcgtctctgaagaatttagggctgaccatccattcctcttctgtatcaagcacatcgcaaccaacgccgttctcttctttggcagatgtgtttctgccggcccagaggaggcaatggcagcagaggaggcaatggcagcagaggaggcaatggcagcgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattctgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactagtgggtgagaagttgaacaagagtcccctacaagcaacttaatctaataagctagtggtctacatcagctaaaagagcatagtgagggatgaaattggttctcctttctaagcatcacctgggacaactcatctggagcagtgtgtccaatctgccgctgccctgatctcggctggggtgatgggacagaccttggctgccactgagacatctgagacactgagatctgtctcaactcagatttacccaagaacagctcattgccaacagaacaaaatctcaaacttatggctagtgatgacagcagtcagttgtcccatctgtgacccaccaaggctggcatgctggaatgagcaggctttggtggcatgtagttactggacagcaccactgacatgggcaggggaaaaactgagcatggtgtaaatcactgcctcaaagccacttctctgtgcctgcaccatgcttgaaagctcttctacaggagctgggtttgttcaagaaagcttctgtttctcccatctgcttcttgtaccttcacagggacagagttagaagggtacagccatggctggaaggggctgactttcaaatgtgcctaattttcctttggttgctgctgcagctgcagaagaaggggttcagaagccaagagctttgagataaggatgcctaacctatgttgaagacatttgtgctgacacctcaggccccaggataggacaactgctggattgtggctaacccactagctacagaacctaatttatattaccagattaggaagagcaaaagaacatgtatttataacaggaggtcttctgtgcttctctactaaaaggtgctgtgaaggagcccacagtgcagcagtgtatgaggcctgaaagaggccgcagcacacgaagagccctggtaggagcagcacacagaggggcaggagggctgggggaactgccacccatggggacctgtgtgaagcagtgcactcctgaggggtggactgcgtgggaaaggaaaagaaagcaaacagacctgtgatgaactgtcacacagactgcagagtgacagaggagggcacgaggcagtgcgcccactgcagggagtggcgctccttcctcacagcagcgcttaattaaggcgcctgcaggatttaaatcacgtgatcacgtcgtacgcaattggtttaaacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 22 - DNA, 15020 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagggcgcgccgccaggtggactatgaactcacatccaaaggagcttgacctgatacctgattttcttcaaactggggaaacaacacaatcccacaaaacagctcagagagaaaccatcactgatggctacagcaccaaggtatgcaatggcaatccattcgacattcatctgtgacctgagcaaaatgatttatctctccatgaatggttgcttctttccctcatgaaaaggcaatttccacactcacaatatgcaacaaagacaaacagagaacaattaatgtgctccttcctaatgtcaaaattgtagtggcaaagaggagaacaaaatctcaagttctgagtaggttttagtgattggataagaggctttgacctgtgagctcacctggacttcatatccttttggataaaaagtgcttttataactttcaggtctccgagtctttattcatgagactgttggtttagggacagacccacaatgaaatgcctggcataggaaagggcagcagagccttagctgaccttttcttgggacaagcattgtcaaacaatgtgtgacaaaactatttgtactgctttgcacagctgtgctgggcagggcaatccattgccacctatcccaggtaaccttccaactgcaagaagattgttgcttactctctctagaaagcttctgcagactgacatgcatttcataggtagagataacatttactgggaagcacatctatcatcataaaaagcaggcaagattttcagactttcttagtggctgaaatagaagcaaaagacgtgattaaaaacaaaatgaaacaaaaaaaatcagttgatacctgtggtgtagacatccagcaaaaaaatattatttgcactaccatcttgtcttaagtcctcagacttggcaaggagaatgtagatttctacagtatatatgttttcacaaaaggaaggagagaaacaaaagaaaatggcactgactaaacttcagctagtggtataggaaagtaattctgcttaacagagattgcagtgatctctatgtatgtcctgaagaattatgttgtacttttttcccccatttttaaatcaaacagtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaagtttgttataaagcattcacacccataaaaagatagatttaaatattccagctataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtagatacaagaaggatcaaatgaaacagacttctggtctgttactacaaccatagtaataagcacactaactaataattgctaattatgttttccatctctaaggttcccacatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcgtcaaaggtcaaacttctgaagggaacctgtgggtgggtcacaattcaggctatatattccccagggctcagccagtggatcaacatacagctagaaagctgtattgcctttagcagtcaagctcgaaaggtaagcaactctctggaattaccttctctctatattagctcttacttgcacctaaactttaaaaaattaacaattattgtgctatgtgttgtatctttaagggtgaagtacctgcgtgataccccctataaaaacttctcacctgtgtatgcattctgcactattttattatgtgtaaaagctttgtgtttgttttcaggaggcttattctttgtgcttaaaatatgtttttaatttcagaacatcttatcctgtcgttcactatctgatatgctttgcagtttgcttgattaacttctagccctacagagtgcacagagagcaaaatcatggtgttcagtgaattctggggagttattttaatgtgaaaattctctagaagtttaattcctgcaaagtgcagctgctgatcactacacaagataaaaatgtggggggtgcataaacgtatattcttacaataatagatacatgtgaacttatatacagaaaagaaaatgagaaaaatgtgtgtgtgtatactcacacacgtggtcagtaaaaacttttgaggggtttaatacagaaaatccaatcctgaggccccagcactcagtacgcatataaagggctgggctctgaaggacttctgactttcacagattatataaatctcaggaaagcaactagattcatgctggctccaaaagctgtgctttatataagcacactggctatacaatagttgtacagttcagctctttataatagaaacagacagaacaagtataaatcttctattggtctatgtcatgaacaagaattcattcagtggctctgttttatagtaaacattgctattttatcatgtctgcatttctcttctgtctgaatgtcaccactaaaatttaactccacagaaagtttatactacagtacacatgcatatctttgagcaaagcaaaccatacctgaaagtgcaatagagcagaatatgaattacatgcgtgtctttctcctagactacatgaccccatataaactacattccttatctattctgccatcaccaaaacaaaggtaaaaatacttttgaagatctactcatagcaagtagtgtgcaacaaacagatatttctctacatttatttttagggaataaaaataagaaataaaatagtcagcaagcctctgctttctcatatatctgtccaaacctaaagtttactgaaatttgctctttgaatttccagttttgcaagcctatcagattgtgttttaatcagaggtactgaaaagtatcaatgaattctagctttcactgaacaaaaatatgtagaggcaactggcttctgggacagtttgctacccaaaagacaactgaatgcaaatacataaatagatttatgaatatggttttgaacatgcacatgagaggtggatatagcaacagacacattaccacagaattactttaaaactacttgttaacatttaattgcctaaaaactgctcgtaatttactgttgtagcctaccatagagtaccctgcatggtactatgtacagcattccatccttacattttcactgttctgctgtttgctctagacaactcagagttcaccatgggctccatcggtgcagcaagcatggaattttgttttgatgtattcaaggagctcaaagtccaccatgccaatgagaacatcttctactgccccattgccatcatgtcagctctagccatggtatacctgggtgcaaaagacagcaccaggacacaaataaataaggttgttcgctttgataaacttccaggattcggagacagtattgaagctcagtgtggcacatctgtaaacgttcactcttcacttagagacatcctcaaccaaatcaccaaaccaaatgatgtttattcgttcagccttgccagtagactttatgctgaagagagatacccaatcctgccagaatacttgcagtgtgtgaaggaactgtatagaggaggcttggaacctatcaactttcaaacagctgcagatcaagccagagagctcatcaattcctgggtagaaagtcagacaaatggaattatcagaaatgtccttcagccaagctccgtggattctcaaactgcaatggttctggttaatgccattgtcttcaaaggactgtgggagaaagcatttaaggatgaagacacacaagcaatgcctttcagagtgactgagcaagaaagcaaacctgtgcagatgatgtaccagattggtttatttagagtggcatcaatggcttctgagaaaatgaagatcctggagcttccatttgccagtgggacaatgagcatgttggtgctgttgcctgatgaagtctcaggccttgagcagcttgagagtataatcaactttgaaaaactgactgaatggaccagttctaatgttatggaagagaggaagatcaaagtgtacttacctcgcatgaagatggaggaaaaatacaacctcacatctgtcttaatggctatgggcattactgacgtgtttagctcttcagccaatctgtctggcatctcctcagcagagagcctgaagatatctcaagctgtccatgcagcacatgcagaaatcaatgaagcaggcagagaggtggtagggtcagcagaggctggagtggatgctgcaagcgtctctgaagaatttagggctgaccatccattcctcttctgtatcaagcacatcgcaaccaacgccgttctcttctttggcagatgtgtttctgccggcccagaggaggcaatggcagcagaggaggcaatggcagcagaggaggcaatggcagcgattacaaagatcatgatggcgattacaaagatcatgatatcgattacaaagatgacgatgacaaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattctgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcgacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactagtgggtgagaagttgaacaagagtcccctacaagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacgcaattggtttaaacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 23 - DNA, 14170 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgagcgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagggcgcgccgccaggtggactatgaactcacatccaaaggagcttgacctgatacctgattttcttcaaacaggggaaacaacacaatcccacaaaacagctcagagagaaaccatcactgatggctacagcaccaaggtatgcaatggcaatccattcgacattcatctgtgacctgagcaaaatgatttctctctccatgaatggttgcttctttccctcatgaaaaggcaatttccacactcacaatatgcaacaaagacaaacagagaacaattaatgtgctccttcctaatgtcaaaattgtagtggcaaagaggagaacaaaatctcaagttctgagtaggttttagtgattggataagaggctttgacctgtgagctcacctggacttcatatccttttggataaaaagtgcttttataactttcaggtctccgagtctttattcatgagactgttggtttagggacagacccacaatgaaatgcctggcataggaaagggcagcagagccttagctgaccttttcttgggacaagcattgtcaaacaatgtgtgacaaaactatttgtactgctttgcacagctgtgctgggcagggcaatccattgccacctatcccaggtaaccttccaactgcaagaagattgttgcttactctctctagaaagcttctgcagactgacatgcatttcataggtagagataacatttactgggaagcacatctatcatcacaaaaagcaggcaagattttcagactttcttagtggctgaaatagaagcaaaagacgtaattaaaaacaaaatgaaacaaaaaaaatcagttgatacctgtggtgtagacatccagcaaaaaaatattatttgcactaccatcttgtcttaagtcctcagacttagcaaggagaatgtagatttccacagtatatatgttttcacaaaaggaaggagagaaacaaaagaaaatggcactgactaaacttcagctagtggtataggaaagtaattctgcttaacagagattgcagtgatctctatgtatgtcctgaagaattatgttgtacttttttcccccatttttaaatcaaacagtgctttacagaggtcagaatagtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggtgtcaaaggtcaaacttctgaagggaacctgtgggtgggtcacaattcaggctatatattccccagggctcagccagtctcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattctgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctgccgctgccctgatcctggctggggtgatgggacagaccttggctgccactgagacatctgagacactgagatctgtctcaactcagatttacccaagaacagatcattgccaacagaacaaaatctcaaacttatggctagtgatgacagcagtcagttgtcccatctgtgacccaccaaggctggcatgctggaatgagcaggctttggtggcttgtagttactggacagcaccactgacatgggcaggggaaaaactgagcatggtgtaaatcactgcctcaaagccacttctctgtgcctgcaccatgcttgaaagctcttctacaggagctgggtttgttcaagaaagcttctgtttctcccatctgcttcttgtaccttcacagggacagagttagaagggtacagccatggctggaaggggctgactttcaaatgtgcctaattttcctttggttgctgctgcagctgcagaagaaggggttcagaagccaagagctttgagataaggatgcctaacctatgttgaagacatttgtgctgacacctcaggccccaggataggacaactgctggattgtggctaacccactagctacagaacctaatttatattaccagattaggaagagcaaaagaacatgtatttataacaggaggtcttctgtgcttctctactaaaaggtgctgtgaaggagcccacagtgcagcagtgtatgaggcctgaaagaggccgcagcacacgaagagccctggtaggagcagcacacagaggggcaggagggctgggggaactgccacccatggggacctgtgtgaagcagtgcactcctgaggggtggactgcgtgggaaaggaaaagaaagcaaacagacctgtgatgaactgtcacacagactgcagagtgacagaggagggcttgaggcagtgcgcttactgcagggagtggcgctccttcctcacagcagcgcttaattaaggcgcctgcaggatttaaatcacgtgatcacgtcgtacgcaattggtttaaacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 24 - DNA, 14160 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagggcgcgccgccaggtggactatgaactcacatccaaaggagcttgacctgatacctgattttcttcaaacaggggaaacaacacaatcccacaaaacagctcagagagaaaccatcactgatggctacagcaccaaggtatgcaatggcaatccattcgacattcatctgtgacctgagcaaaatgatttctctctccatgaatggttgcttctttccctcatgaaaaggcaatttccacactcacaatatgcaacaaagacaaacagagaacaattaatgtgctccttcctaatgtcaaaattgtagtggcaaagaggagaacaaaatctcaagttctgagtaggttttagtgattggataagaggctttgacctgtgagctcacctggacttcatatccttttggataaaaagtgcttttataactttcaggtctccgagtctttattcatgagactgttggtttagggacagacccacaatgaaatgcctggcataggaaagggcagcagagccttagctgaccttttcttgggacaagcattgtcaaacaatgtgtgacaaaactatttgtactgctttgcacagctgtgctgggcagggcaatccattgccacctatcccaggtaaccttccaactgcaagaagattgttgcttactctctctagaaagcttctgcagactgacatgcatttcataggtagagataacatttactgggaagcacatctatcatcacaaaaagcaggcaagattttcagactttcttagtggctgaaatagaagcaaaagacgtaattaaaaacaaaatgaaacaaaaaaaatcagttgatacctgtggtgtagacatccagcaaaaaaatattatttgcactaccatcttgtcttaagtcctcagacttagcaaggagaatgtagatttccacagtatatatgttttcacaaaaggaaggagagaaacaaaagaaaatggcactgactaaacttcagctagtggtataggaaagtaattctgcttaacagagattgcagtgatctctatgtatgtcctgaagaattatgttgtacttttttcccccatttttaaatcaaacagtgctttacagaggtcagaatagtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggtgtcaaaggtcaaacttctgaagggaacctgtgggtgggtcacaattcaggctatatattccccagggctcagccagtctcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattctgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctgccgctgccctgatcctggctggggtgatgggacagaccttggctgccactgagacatctgagacactgagatctgtctcaactcagatttacccaagaacagatcattgccaacagaacaaaatctcaaacttatggctagtgatgacagcagtcagttgtcccatctgtgacccaccaaggctggcatgctggaatgagcaggctttggtggcttgtagttactggacagcaccactgacatgggcaggggaaaaactgagcatggtgtaaatcactgcctcaaagccacttctctgtgcctgcaccatgcttgaaagctcttctacaggagctgggtttgttcaagaaagcttctgtttctcccatctgcttcttgtaccttcacagggacagagttagaagggtacagccatggctggaaggggctgactttcaaatgtgcctaattttcctttggttgctgctgcagctgcagaagaaggggttcagaagccaagagctttgagataaggatgcctaacctatgttgaagacatttgtgctgacacctcaggccccaggataggacaactgctggattgtggctaacccactagctacagaacctaatttatattaccagattaggaagagcaaaagaacatgtatttataacaggaggtcttctgtgcttctctactaaaaggtgctgtgaaggagcccacagtgcagcagtgtatgaggcctgaaagaggccgcagcacacgaagagccctggtaggagcagcacacagaggggcaggagggctgggggaactgccacccatggggacctgtgtgaagcagtgcactcctgaggggtggactgcgtgggaaaggaaaagaaagcaaacagacctgtgatgaactgtcacacagactgcagagtgacagaggagggcttgaggcagtgcgcttactgcagggagtggcgctccttcctcacagcagcgcttaaggcgcctgcaggatttaaatcacgtgatcacgtcgtacgcaattggtttaaacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 25 - DNA, 13530 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcgccgtgtattgattgctcagtgaagtcagacctgctcctctcagcatccttcaccatcgctcagccctggcagagtttctatcatcccttgtcatcagctgcatgagcaacgctcagaagtcagccctcttctctcttttgtagcttatctttacattagtatcaacaaaatgcaaacatagataaaaggaggatttttatagatgccttattaacagaagctacttactcactgagtgcaagcttacttaaaacaagctctgaaaggatcattctccccctcccactctactgaagtgctgctagtactactaattcagactgggtgaatttactcttgcttgaatccagcacaagtcatgtgtactctggggaagagggggattaaacagcttttaaattatgtttggaagtccttctcacaactctgttcaggggagggttttatccactactacttttattttattttattttattttattttattttattttgttttattttattttatttattttggcattgtttatgtgtatattcatgggtttggatcgtgtcaaggctgctagatagtctttcatcactttgtagcatttaacgtttttggaaaacattatctgggttaatacatattacaaaaaatgagcattcagtctttttctctctgtcttaatttaaatgcagttttgattgaggctgaacttatgtatttttaattgcaaataaatgttctgttccctcctttgctttttttctttgtcttttctttgaaactagatgcttcctttgttttctgtttatgaaaccttttccagaaaatgattacttcatgtatgggtctttggtggcacatagagattctgcagatattattttaattaggttgcttggttccatttcatgtctaaatggctgtggcatggaccttgcgctcgagggcgcgccgccaggtggactatgaactcacatccaaaggagcttgacctgatacctgattttcttcaaacaggggaaacaacacaatcccacaaaacagctcagagagaaaccatcactgatggctacagcaccaaggtatgcaatggcaatccattcgacattcatctgtgacctgagcaaaatgatttctctctccatgaatggttgcttctttccctcatgaaaaggcaatttccacactcacaatatgcaacaaagacaaacagagaacaattaatgtgctccttcctaatgtcaaaattgtagtggcaaagaggagaacaaaatctcaagttctgagtaggttttagtgattggataagaggctttgacctgtgagctcacctggacttcatatccttttggataaaaagtgcttttataactttcaggtctccgagtctttattcatgagactgttggtttagggacagacccacaatgaaatgcctggcataggaaagggcagcagagccttagctgaccttttcttgggacaagcattgtcaaacaatgtgtgacaaaactatttgtactgctttgcacagctgtgctgggcagggcaatccattgccacctatcccaggtaaccttccaactgcaagaagattgttgcttactctctctagaaagcttctgcagactgacatgcatttcataggtagagataacatttactgggaagcacatctatcatcacaaaaagcaggcaagattttcagactttcttagtggctgaaatagaagcaaaagacgtaattaaaaacaaaatgaaacaaaaaaaatcagttgatacctgtggtgtagacatccagcaaaaaaatattatttgcactaccatcttgtcttaagtcctcagacttagcaaggagaatgtagatttccacagtatatatgttttcacaaaaggaaggagagaaacaaaagaaaatggcactgactaaacttcagctagtggtataggaaagtaattctgcttaacagagattgcagtgatctctatgtatgtcctgaagaattatgttgtacttttttcccccatttttaaatcaaacagtgctttacagaggtcagaatagtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggtgtcaaaggtcaaacttctgaagggaacctgtgggtgggtcacaattcaggctatatattccccagggctcagccagtctcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattctgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctgccgctgccctgatcctggctggggtgatgggacagaccttggctgccactgagacatctgagacactgagatctgtctcaactcagatttacccaagaacagatcattgccaacagaacaaaatctcaaacttatggctagtgatgacagcagtcagttgtcccatctgtgacccaccaaggctggcatgctggaatgagcaggctttggtggcttgtagttactggacagcaccactgacatgggcaggggaaaaactgagcatggtgtaaatcactgcctcaaagccacttctctgtgcctgcaccatgcttgaaagctcttctacaggagctgggtttgttcaagaaagcttctgtttctcccatctgcttcttgtaccttcacagggacagagttagaagggtacagccatggctggaaggggctgactttcaaatgtgcctaattttcctttggttgctgctgcagctgcagaagaaggggttcagaagccaagagctttgagataaggatgcctaacctatgttgaagacatttgtgctgacacctcaggccccaggataggacaactgctggattgtggctaacccactagctacagaacctaatttatattaccagattaggaagagcaaaagaacatgtatttataacaggaggtcttctgtgcttctctactaaaaggtgctgtgaaggagcccacagtgcagcagtgtatgaggcctgaaagaggccgcagcacacgaagagccctggtaggagcagcacacagaggggcaggagggctgggggaactgccacccatggggacctgtgtgaagcagtgcactcctgaggggtggactgcgtgggaaaggaaaagaaagcaaacagacctgtgatgaactgtcacacagactgcagagtgacagaggagggcttgaggcagtgcgcttactgcagggagtggcgctccttcctcacagcagcgcttaattaaggcgcctgcaggatttaaatcacgtgatcacgtcgtacggccgtgtattgattgctcagtgaagtcagacctgctcctctcagcatccttcaccatcgctcagccctggcagagtttctatcatcccttgtcatcagctgcatgagcaacgctcagaagtcagccctcttctctcttttgtagcttatctttacattagtatcaacaaaatgcaaacatagataaaaggaggatttttatagatgccttattaacagaagctacttactcactgagtgcaagcttacttaaaacaagctctgaaaggatcattctccccctcccactctactgaagtgctgctagtactactaattcagactgggtgaatttactcttgcttgaatccagcacaagtcatgtgtactctggggaagagggggattaaacagcttttaaattatgtttggaagtccttctcacaactctgttcaggggagggttttatccactactacttttattttattttattttattttattttattttattttgttttattttattttatttattttggcattgtttatgtgtatattcatgggtttggatcgtgtcaaggctgctagatagtctttcatcactttgtagcatttaacgtttttggaaaacattatctgggttaatacatattacaaaaaatgagcattcagtctttttctctctgtcttaatttaaatgcagttttgattgaggctgaacttatgtatttttaattgcaaataaatgttctgttccctcctttgctttttttctttgtcttttctttgaaactagatgcttcctttgttttctgtttatgaaaccttttccagaaaatgattacttcatgtatgggtctttggtggcacatagagattctgcagatattattttaattaggttgcttggttccatttcatgtctaaatggctgtggcatggaccttgcggggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 26 - DNA, 15062 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgccaggtggactatgaactcacatccaaaggagcttgacctgatacctgattttcttcaaacaggggaaacaacacaatcccacaaaacagctcagagagaaaccatcactgatggctacagcaccaaggtatgcaatggcaatccattcgacattcatctgtgacctgagcaaaatgatttctctctccatgaatggttgcttctttccctcatgaaaaggcaatttccacactcacaatatgcaacaaagacaaacagagaacaattaatgtgctccttcctaatgtcaaaattgtagtggcaaagaggagaacaaaatctcaagttctgagtaggttttagtgattggataagaggctttgacctgtgagctcacctggacttcatatccttttggataaaaagtgcttttataactttcaggtctccgagtctttattcatgagactgttggtttagggacagacccacaatgaaatgcctggcataggaaagggcagcagagccttagctgaccttttcttgggacaagcattgtcaaacaatgtgtgacaaaactatttgtactgctttgcacagctgtgctgggcagggcaatccattgccacctatcccaggtaaccttccaactgcaagaagattgttgcttactctctctagaaagcttctgcagactgacatgcatttcataggtagagataacatttactgggaagcacatctatcatcacaaaaagcaggcaagattttcagactttcttagtggctgaaatagaagcaaaagacgtaattaaaaacaaaatgaaacaaaaaaaatcagttgatacctgtggtgtagacatccagcaaaaaaatattatttgcactaccatcttgtcttaagtcctcagacttagcaaggagaatgtagatttccacagtatatatgttttcacaaaaggaaggagagaaacaaaagaaaatggcactgactaaacttcagctagtggtataggaaagtaattctgcttaacagagattgcagtgatctctatgtatgtcctgaagaattatgttgtacttttttcccccatttttaaatcaaacagtgctttacagaggtcagaatagtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggtgtcaaaggtcaaacttctgaagggaacctgtgggtgggtcacaattcaggctatatattccccagggctcagccagtctcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattctgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctgccgctgccctgatcctggctggggtgatgggacagaccttggctgccactgagacatctgagacactgagatctgtctcaactcagatttacccaagaacagatcattgccaacagaacaaaatctcaaacttatggctagtgatgacagcagtcagttgtcccatctgtgacccaccaaggctggcatgctggaatgagcaggctttggtggcttgtagttactggacagcaccactgacatgggcaggggaaaaactgagcatggtgtaaatcactgcctcaaagccacttctctgtgcctgcaccatgcttgaaagctcttctacaggagctgggtttgttcaagaaagcttctgtttctcccatctgcttcttgtaccttcacagggacagagttagaagggtacagccatggctggaaggggctgactttcaaatgtgcctaattttcctttggttgctgctgcagctgcagaagaaggggttcagaagccaagagctttgagataaggatgcctaacctatgttgaagacatttgtgctgacacctcaggccccaggataggacaactgctggattgtggctaacccactagctacagaacctaatttatattaccagattaggaagagcaaaagaacatgtatttataacaggaggtcttctgtgcttctctactaaaaggtgctgtgaaggagcccacagtgcagcagtgtatgaggcctgaaagaggccgcagcacacgaagagccctggtaggagcagcacacagaggggcaggagggctgggggaactgccacccatggggacctgtgtgaagcagtgcactcctgaggggtggactgcgtgggaaaggaaaagaaagcaaacagacctgtgatgaactgtcacacagactgcagagtgacagaggagggcttgaggcagtgcgcttactgcagggagtggcgctccttcctcacagcagcgcttaaggcgcctgcaggatttaaatcacgtgatcacgtcgtacgcaattggtttaaacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 27 - DNA, 11391 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgagcgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattctgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggccgctctagaccaggcgcctggatccagatcacttctggctaataaaagatcagagctctagagatctgtgtgttggttttttgtggatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacctctctctctctctctctctctctctctctctctctctctctggtacctctctctctctctctctctctctctctctctctctctggtacccaggtgctgaagaattgacccctcgagggcgcgcctcagcgatcgcagatctttaattaaggcgcctgcaggatttaaatcacgtgatcacgtcgtacgcaattggtttaaacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 28 - DNA, 13605 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggccgctctagaccaggcgcctggatccagatcacttctggctaataaaagatcagagctctagagatctgtgtgttggttttttgtggatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacctctctctctctctctctctctctctctctctctctctctctggtacctctctctctctctctctctctctctctctctctctctggtacccaggtgctgaagaattgacccctcgagggcgcgcctcagcgatcgcagatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 29 - DNA, 13604 bp, Artificial Sequence
  Synthetic Construct
tgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgaggggtcaattcttcagcacctgggtaccagagagagagagagagagagagagagagagagagagaggtaccagagagagagagagagagagagagagagagagagagagagaggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagcagatccacaaaaaaccaacacacagatctctagagctctgatcttttattagccagaagtgatctggatccaggcgcctggtctagagcggcctagaagccacagctgccctccacagagcggcactgcacgatgcgcaggaatgtctcgaccttgtccatgtccttcctgaagcagtagagcagcccgtagttcttgagcagtgcgtcatcgttgtgtgagtttgtgtcgaacttgctgtaggtctgcttgaagatctgcccagttctggggctgccatcttccagcctccccatcagtgtttggatgccttcctccaggtccttcaggaggtcatagacgttgctgtcagaggcgccgtacaccaggctgttggcgaagacactcctgaggaactgcacgggctccagccaggactggatgagcagcagggagatgcggagcagctccaggttggatttctgttgtgtttcctccctgttggagggtgtcggaatagactctgagaaacagagggaggtctgggggttctgcaggaatgaatacttctgttcctttgggatataggcttcttcaaactcctggtaggtgtcaaaggccagctggtgcagtctatgggcgcggagcatagcgttgtcaaaaagacgtgacaagggaatggttgggaatttgtcatcgtcatctttgtaatcgatatcatgatctttgtaatcgccatcatgatctttgtaatcaccggcagcggcgaaacacacagccgctatccccaaggacagcacggtgcagaggatgagcttcatgttgtcgacgacggtgactgcagaaaagacccatggaaaggaacagtctgttagtctgtcagctattatgtctggtggcgcgcgcggcagcaacgagtactgctcagactacactgccctccaccgttaacagcaccgcaacgggagttacctctgactcttatcagaatacaacaactcagctgcctgcatcttcttctgccgctgccttaagtcttccatctgcgtcagccgtgcgagcccaatctccacgctcattttcagacacataccctaccgccacggccttgtgcggcacactggtggtggtgggcattgtgctgtgcctaagtctggcctccactgttaggagcaaggagctgccgagcgaccatgagccgctggaggcatgggaccagggctcggatgtggaagctccgccgctaccggagaagagcccatgtccggaacacgtacccgagattcgcgtggagatcccacgctatgtttaataaaaactgcgggcacgggggacggcgttgttgtatatgtgaatttgtaaataataaatgggaccccatcctgtaaaaatacagagtccgtgtcagtctctgaaggacagagtattggcatatagccaatagagatagttgtggcaaagagccatgttatggattagtaatggaaagtatcgtcaccaataggggagtggtcaataatggtcaataacccacacctataggctaagctataccatcacctatagcataaggaagcgggggtgtataggccccaagccaaaaacagtatagcatgcataagagccaaaggggtgtgcctatagagtctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacatggcggtaatgttggacatgagccaatataaatgtacatattatgatatggatacaacgtatgcaatggccaatagccaatctgatgctcgagggcgcgcctcagcgatcgcagatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 30 - DNA, 14170 bp, Artificial Sequence; identical to SEQ ID NO: 23
  Synthetic Construct

SEQ ID NO: 31 - DNA, 15890 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctgccgctgccctgatcctggctggggtgatgggacagaccttggctgccactgagacatctgagacactgagatctgtctcaactcagatttacccaagaacagatcattgccaacagaacaaaatctcaaacttatggctagtgatgacagcagtcagttgtcccatctgtgacccaccaaggctggcatgctggaatgagcaggctttggtggcttgtagttactggacagcaccactgacatgggcaggggaaaaactgagcatggtgtaaatcactgcctcaaagccacttctctgtgcctgcaccatgcttgaaagctcttctacaggagctgggtttgttcaagaaagcttctgtttctcccatctgcttcttgtaccttcacagggacagagttagaagggtacagccatggctggaaggggctgactttcaaatgtgcctaattttcctttggttgctgctgcagctgcagaagaaggggttcagaagccaagagctttgagataaggatgcctaacctatgttgaagacatttgtgctgacacctcaggccccaggataggacaactgctggattgtggctaacccactagctacagaacctaatttatattaccagattaggaagagcaaaagaacatgtatttataacaggaggtcttctgtgcttctctactaaaaggtgctgtgaaggagcccacagtgcagcagtgtatgaggcctgaaagaggccgcagcacacgaagagccctggtaggagcagcacacagaggggcaggagggctgggggaactgccacccatggggacctgtgtgaagcagtgcactcctgaggggtggactgcgtgggaaaggaaaagaaagcaaacagacctgtgatgaactgtcacacagactgcagagtgacagaggagggcttgaggcagtgcgcttactgcagggagtggcgctccttcctcacagcagcgctaacagcttgttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 32 - DNA, 14905 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 33 - DNA, 12994 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccacgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacgcaattggtttaaacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 34 - DNA, 13311 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccactgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgggatcctcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacgcaattggtttaaacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 35 - DNA, 14312 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccacgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 36 - DNA, 14623 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccactgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcctcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 37 - DNA, 14839 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctagcgctttcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 38 - DNA, 14830 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccttcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 39 - DNA, 14882 bp, Artificial Sequence
  Synthetic Construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgattacaaagatcatgatggcgattacaaagatcatgatatcgattacaaagatgacgatgacaaattcccaaccattcccttgtcacgtctttttgacaacgctatgctccgcgcccatagactgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctggagctgctccgcatctccctgctgctcatccagtcctggctggagcccgtgcagttcctcaggagtgtcttcgccaacagcctggtgtacggcgcctctgacagcaacgtctatgacctcctgaaggacctggaggaaggcatccaaacactgatggggaggctggaagatggcagccccagaactgggcagatcttcaagcagacctacagcaagttcgacacaaactcacacaacgatgacgcactgctcaagaactacgggctgctctactgcttcaggaaggacatggacaaggtcgagacattcctgcgcatcgtgcagtgccgctctgtggagggcagctgtggcttctaggacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 40 - DNA, 6 bp, Artificial Sequence
  Kozak sequence
accatg

SEQ ID NO: 41 - DNA, 7 bp, Artificial Sequence
  Kozak sequence
accatgg

SEQ ID NO: 42 - DNA, 7 bp, Artificial Sequence
  Kozak sequence
accatgt

SEQ ID NO: 43 - DNA, 7 bp, Artificial Sequence
  Kozak sequence
aagatgt

SEQ ID NO: 44 - DNA, 7 bp, Artificial Sequence
  Kozak sequence
acgatga

SEQ ID NO: 45 - DNA, 7 bp, Artificial Sequence
  Kozak sequence
aagatgg

SEQ ID NO: 46 - DNA, 7 bp, Artificial Sequence
  Kozak sequence
gacatga

SEQ ID NO: 47 - DNA, 7 bp, Artificial Sequence
  Kozak sequence
accatga

SEQ ID NO: 48 - DNA, 7 bp, Artificial Sequence
  Kozak sequence
accatgt

SEQ ID NO: 49 - DNA, 6 bp, Artificial Sequence
  Kozak sequence
gggatg

SEQ ID NO: 50 - DNA, 680 bp, Gallus sp.
ccgggctgcagaaaaatgccaggtggactatgaactcacatccaaaggagcttgacctgatacctgattttcttcaaactggggaaacaacacaatcccacaaaacagctcagagagaaaccatcactgatggctacagcaccaaggtatgcaatggcaatccattcgacattcatctgtgacctgagcaaaatgatttatctctccatgaatggttgcttctttccctcatgaaaaggcaatttccacactcacaatatgcaacaaagacaaacagagaacaattaatgtgctccttcctaatgtcaaaattgtagtggcaaagaggagaacaaaatctcaagttctgagtaggttttagtgattggataagaggctttgacctgtgagctcacctggacttcatatccttttggataaaaagtgcttttataactttcaggtctccgagtctttattcatgagactgttggtttagggacagacccacaatgaaatgcctggcataggaaagggcagcagagccttagctgaccttttcttgggacaagcattgtcaaacaatgtgtgacaaaactatttgtactgctttgcacagctgtgctgggcagggcaatccattgccacctatcccaggtaaccttccaactgcaagaagattgttgcttactctctctaga

SEQ ID NO: 51 - DNA, 72 bp, Artificial Sequence
  Synthetic Construct
gtggatcaacatacagctagaaagctgtattgcctttagcactcaagctcaaaagacaactcagagttcacc

SEQ ID NO: 52 - DNA, 62 bp, Artificial Sequence
  Synthetic Construct
acatacagctagaaagctgtattgcctttagcactcaagctcaaaagacaactcagagttca

---

The invention claimed is:

1. A vector comprising:
a modified transposase gene operably linked to a first promoter, wherein the nucleotide sequence 3' to the first promoter comprises a modified Kozak sequence, and wherein a plurality of the first twenty codons of the transposase gene are modified from the wild-type sequence by changing the nucleotide at the third base position of the codon to an adenine or thymine without modifying the amino acid encoded by the codon;
a multiple cloning site capable of receiving a gene of interest;
transposon insertion sequences recognized by a transposase encoded by the modified transposase gene, wherein the transposon insertion sequences flank the multiple cloning site; and,
one or more insulator elements located between the transposon insertion sequences and the multiple cloning site, wherein the one or more insulator elements comprise a lysozyme replicator element, a combination of a lysozyme replicator element and an HS4 element, or a matrix attachment region element, wherein when the gene of interest is inserted into the multiple cloning site, the start codon of the gene of interest is located no more than 3006 bp and no less than 1659 bp from the one or more insulator elements located 5' to the start codon of the gene of interest.

2. The vector of claim 1, further comprising a second promoter, wherein the second promoter is SEQ ID NO: 14 or SEQ ID NO: 15.

3. The vector of claim 1, further comprising a gene encoding for growth hormone inserted into the multiple cloning site.

4. The vector of claim 3, wherein the vector comprises SEQ ID NO: 31 or SEQ ID NO:32.

5. A transposon-based vector comprising:
a modified transposase gene operably linked to a first promoter, wherein the nucleotide sequence 3' to the first promoter comprises a modified Kozak sequence, and wherein a plurality of the first twenty codons of the transposase gene are modified from the wild-type sequence by changing the nucleotide at the third base position of the codon to an adenine or thymine without modifying the amino acid encoded by the codon;

one or more genes of interest encoding growth hormone operably-linked to one or more additional promoters, wherein the one or more genes of interest encoding growth hormone and their operably-linked promoters are flanked by transposon insertion sequences recognized by a transposase encoded by the modified transposase gene; and, one or more insulator elements located between the transposon insertion sequences and the one or more genes of interest encoding growth hormone, wherein the start codon of the gene of interest is located about 3006 bp to about 1659 bp from the one or more insulator elements located 5' to the start codon of the gene of interest, and wherein the one or more insulator elements comprise a lysozyme replicator element, a combination of a lysozyme replicator element and an HS4 element, or a matrix attachment region element.

6. A method of producing growth hormone comprising:
transfecting a cell with a vector comprising a modified transposase gene operably linked to a first promoter, wherein the nucleotide sequence 3' to the first promoter comprises a modified Kozak sequence, and wherein a plurality of the first twenty codons of the transposase gene are modified from the wild-type sequence by changing the nucleotide at the third base position of the codon to an adenine or thymine without modifying the amino acid encoded by the codon;

one or more genes of interest encoding growth hormone operably-linked to one or more additional promoters, wherein the one or more genes of interest encoding growth hormone and their operably-linked promoters are flanked by transposon insertion sequences recognized by a transposase encoded by the modified transposase gene; and, one or more insulator elements located between the transposon insertion sequences and the one or more genes of interest encoding growth hormone, wherein the start codon of the gene of interest is located about 3006 by to about 1659 by from the one or more insulator elements located 5' to the start codon of the gene of interest, and wherein the one or more insulator elements comprise a lysozyme replicator element, a combination of a lysozyme replicator element and an HS4 element, or a matrix attachment region element;

culturing the transfected cell in culture medium;

permitting the cell to release growth hormone into the culture medium;

collecting the culture medium; and, isolating the growth hormone.

7. The method of claim 6 wherein the vector comprises SEQ ID NO:31 or SEQ ID NO:32.

8. The method of claim 6 wherein the growth hormone is human growth hormone.

* * * * *